(12) United States Patent
Prato et al.

(10) Patent No.: US 9,556,238 B2
(45) Date of Patent: Jan. 31, 2017

(54) MAGNETOSOME GENE EXPRESSION IN EUKARYOTIC CELLS

(75) Inventors: Frank S Prato, London (CA); Donna E Goldhawk, London (CA); Cheryl R McCreary, Balzac (CA); Rebecca McGirr, London (CA); Savita Dhanvantari, London (CA); Terry R Thompson, London (CA); Alex W Thomas, London (CA); David Hill, London (CA)

(73) Assignee: Multi-Magnetics Inc., London (CA)

( * ) Notice: Subject to any disclaimer, the term of this patent is extended or adjusted under 35 U.S.C. 154(b) by 378 days.

(21) Appl. No.: 12/303,793

(22) PCT Filed: Jun. 8, 2007

(86) PCT No.: PCT/CA2007/001016
§ 371 (c)(1),
(2), (4) Date: Mar. 10, 2009

(87) PCT Pub. No.: WO2007/140617
PCT Pub. Date: Dec. 13, 2007

(65) Prior Publication Data
US 2010/0297022 A1 Nov. 25, 2010

Related U.S. Application Data

(60) Provisional application No. 60/811,784, filed on Jun. 8, 2006, provisional application No. 60/879,791, filed on Jan. 11, 2007.

(51) Int. Cl.
| | | |
|---|---|---|
| *A61K 49/06* | (2006.01) | |
| *A61K 35/12* | (2015.01) | |
| *C12N 15/63* | (2006.01) | |
| *C12N 5/10* | (2006.01) | |
| *C12N 1/00* | (2006.01) | |
| *C07K 14/195* | (2006.01) | |
| *A61K 49/14* | (2006.01) | |
| *A61K 49/18* | (2006.01) | |

(52) U.S. Cl.
CPC .......... *C07K 14/195* (2013.01); *A61K 49/14* (2013.01); *A61K 49/1806* (2013.01); *A61K 49/1896* (2013.01); *C12N 2510/00* (2013.01)

(58) Field of Classification Search
CPC ............................ C12N 2510/00; A61K 49/14
See application file for complete search history.

(56) References Cited

U.S. PATENT DOCUMENTS

2004/0048289 A1* 3/2004 Matsunaga et al. ............... 435/6
2009/0311194 A1* 12/2009 Hu ..................... A61K 49/1818
424/9.321

FOREIGN PATENT DOCUMENTS

JP 62275679 A 11/1987
WO WO 2006119102 11/2006

OTHER PUBLICATIONS

Okamura et al (Applied and Environmental Microbiology. Jul. 2003; 69(7): 4274-4277).*
Matsunaga et al. (Journal of Bacteriology, May 1992; 174(9): 2748-2753).*
Sambrook et al. (Molecular Cloning: a laboratory manual, 2nd ed. Cold Spring Harbor Laboratory Press, Cold Spring Harbor, NY).*
Genove et al. (Nature Medicine. Apr. 2005; 11(4): 450-454).*
Xu et al (Nature Biotechnology. Oct. 2001; 19: 971-974).*
Yoshino et al. (Applied and Environmental Microbiology. American Society for Microbiology. May 2004; 70(5): 2880-2885).*
Roger Tsien (Nature Reviews Molecular Cell Biology 4, SS16-SS21 (2003)).*
Butleand et al. (Physics and Chemistry Basis of Biotechnology: Focus on Biotechnology. vol. 7, 2002; "Molecular and Cellular Magnetic Resonance Contrast Agents," 191-2011).*
Lumelsky et al. (Science. May 18, 2001; 292:1389-1394).*
Martinez et al. (Cancer. Jan. 15, 1996; 77(2): 409-419).*
Brennan et al. (AJR. Sep. 2005; 185: 711-716).*
Moore et al (Radiology. Oct. 2001. 221: 244-250).*
Gorby et al. (Journal of Bacteriology. Feb. 1988; 170(2): 834-841).*
Nimes Nathan et al: "In vivo MRI of embryonic stem cells in a mouse model of myocardial infarction" Magnetic Resonance in Medicine, vol. 52, No. 5, Nov. 2004 (Nov. 2004), pp. 1214-1219, XP002529308. ISSN: 0740-3194.
Jasanoff A: "Functional MRI using molecular imaging agents". Trends in Neuroscience, Elsevier, Amsterdam, NL, vol. 28, No. 3, Mar. 1, 2005 (Mar. 1, 2005), pp. 120-126, XP004771624. ISSN: 0166-2236.
Schuler D: "Formation of magnetosomes in magnetotactic bacteria". Journal of Molecular Microbiology and Biotechnology, Horizon Scientific Press, Wymondham, GB, vol. 1, No. 1, Jan. 1, 1999 (Jan. 1, 1999), pp. 79-86, XP003002490. ISSN : 1464-1801.
Oluda Y et al: "Expression and characterization of a magnetosome-associated protein, TPR-containing MAM22, in *Escherichia coli*", FEBS Letters, Elseview, Amsterdam, NL, vol. 491, No. 3, Mar. 2, 2001 (Mar. 2, 2001), pp. 169-173, XP004257297. ISSN: 0014-5793.
Zurika Omar et al: "MagA is sufficient for producing magnetic nanoparticles in mammalian cells, making it an MRI reporter". Magnetic Resonance in Medicine, vol. 59, No. 6, Jun. 2008 (Jun. 2008), pp. 1225-1231, XP002529309. ISSN: 0740-3194. *the whole document*.
Arbab, A., Bashaw, L., Bradley, R., Jordan, E., Bulte, J., and Frank, J. (2003). Intracytoplasmic tagging of cells with ferumoxides and transfection agent for cellular magnetic resonance imaging after cell transplantation: methods and techniques. Transplantation 76, 1123-1130.

(Continued)

*Primary Examiner* — Scott Long
(74) *Attorney, Agent, or Firm* — Ridout & Maybee LLP

(57) ABSTRACT

The invention is the production of magnetosome-like structures in cells. The invention provides in vitro and in vivo diagnostic and therapeutic methods using eukaryotic cells expressing magnetosome-like structures that act as contrast agents.

20 Claims, 24 Drawing Sheets

(56) References Cited

OTHER PUBLICATIONS

Bauerlein, E., Schuler, D., Reszka, R., and Pauser, S. (2001). Specific magnetosome, method for the production and use thereof, U. P. Office, ed. (United States: Max-Delbruck-Centrum fur Molekulare Medizin and Max-PlanckGesellschaft zur Forderung der Wissenschaften E.V.).
Bauerlein, E., Schuler, D., Reszka, R., and Pauser, S. (2002). Magnetosomes, method for making and using, U. P. Office, ed. (United States).
Bazylinski, D., and Frankel, R. (2004). Magnetosome formation in prokaryotes. Nat Rev Microbiol 2, 217-230.
Bulte, J., Douglas, T., Mann, S., Frankel, R., Moskowits, B., Brooks, R., Baumgartner, C., Vymazal, J., and Frank, J. (1994). Magnetoferritin. Biomineralization as a novel molecular approach in the design of iron-oxide-based magnetic resonance contrast agents. Invest Radiol 29 Suppl.2, S214-S216.
Chalfie, M., Tu, Y., Euskirchen, G., Ward, W., and Prasher, D. (1994). Green fluorescent protein as a marker for gene expression. Science 263, 802-805.
Dhanvantari, S., Foster, P., White, D., McCreary, C., Nguyen, B., Mugimba, A., Chan, K., Hoffman, L., McGirr, R., Kovacs, M., and Wells, R. (2006). Cellular and molecular imaging of pancreatic islet cells, in Keystone Symposium, Towards Understanding Islet Biology.
Dhanvantari, S., Tai, J.-H., White, D., Heyn, C., Rutt, B., and Foster, P. (2004). Single cell magnetic resonance imaging of beta cells, in Annual Meeting of the Canadian Diabetes Association.
Genove, G., DeMarco, U., Xu, H., Goins, W., and Ahrens, E. (2005). A new transgene reporter for in vivo magnetic resonance imaging. Nat Med 11, 450-454.
Grünberg, K., Wawer, C., Tebo, B., and Schüler, D. (2001). A large gene cluster encoding several magnetosome proteins is conserved in different species of magnetotactic bacteria. Appl Env Microbiol 67, 4573-4582.
Hautot, D., Pankhurst, Q., Khan, N., and Dobson, J. (2003). Preliminary evaluation of nanoscale biogenic magnetite in Alzheimer's disease brain tissue. Proc R Soc Lond B (Suppl) 270, S62-S64.
Herborn, C., Papanikolaou, N., Reszka, R., Grunberg, K., Schüler, D., and Debatin, J. (2003). Magnetosomes as biological model for iron binding: relaxivity determination with MRI. Rofo: Fortschritte auf dem Gebiete der Rontgenstrahlen und der Nuklearmedizin 175, 830-834.
Hergt, R., Hiergeist, R., Zeisberger, M., Schuler, D., Heyen, U., Hilger, I., and Kaiser, W. (2005). Magnetic properties of bacterial magnetosomes as potential diagnostic and therapeutic tools. J Magn Magn Mater 293, 80-86.
Hilger, I., Fruhauf, K., Andra, W., Hiergeist, R., Hergt, R., and Kaiser, W. (2002). Heating potential of iron oxides for therapeutic purposes in interventional radiology. Acad Radiol 9, 198-202.
Kirschvink, J. (1989). Magnetite biomineralization and geomagnetic sensitivity in higher animals: an update and recommendations for future study. Bioelectromagnetics 10, 239-259.
Kirschvink, J., Kobayashi-Kirschvink, A., and Woodford, B. (1992). Magnetite biomineralization in the human brain. Proc Nat Acad Sci USA 89, 7683-7687.
Kirschvink, J., Walker, M., and Diebel, C. (2001). Magnetite-based magnetoreception. Curr Opin Neurobiol 11, 462-467.
Komeili, A., Li, Z., Newman, D., and Jensen, G. (2006). Magnetosomes are cell membrane invaginations organized by the actin-like protein MamK. Science 311, 242-245.
Lin, H., Blank, M., and Goodman, R. (1999). A magnetic field-responsive domain in the human HSP70 promoter. J Cell Biochem 75, 170-176.
Matsunaga, T. (2000). Protein-bound magnetic particles and process of producing the same, U. S. P. Office, ed. (United States: TDK Corporation).
Matsunaga, T., Nakamura, C., Burgess, J., and Sode, K. (1992). Gene transfer in magnetic bacteria: transposon mutagenesis and cloning of genomic DNA fragments required for magnetosome synthesis. J Bacteriol 174, 2748-2753.
Matsunaga, T., Takeyama, H., and Okamura, Y. (2004). Magnetic particle membrane-specific protein, U. S. P. Office, ed. (United States).
Okamura, Y., Takeyama, H., and Matsunaga, T. (2001) A magnetosome-specific GTPase from the magnetic bacterium Magnetospirillum magneticum AMB-1. J. Biol. Chem. 276, 48183-48188.
Ritz, T., Thalau, P., Phillips, J., Wiltschko, R., and Wiltschko, W. (2004). Resonance effects indicate a radical-pair mechanism for avian magnetic compass. Nature 429, 177-180.
Schüler, D. (Apr. 2004-Mar. 2006a). Main themes of scientific work, In Biannual Report, Department of Microbiology (Max Planck Institute for Marine Biology), pp. 79-80.
Schüler, D. (Apr. 2004-Mar. 2006b). Survey of major projects, In Biannual Report, Research Concept (Max Planck Institute for Marine Biology ), pp. 13-14.
Schuler, D. (2004) Molecular analysis of a subcellular compartment: the magnetosome membrane in Magnetospirillum gryphiswaldense. Arch. Microbiol. 181, 1-7.
Schüler, D., and Frankel, R. (1999). Bacterial magnetosomes: microbiology, biomineralization and biotechnological applications. Appl Microbiol Biotechnol 52, 464-473.
Southward, C., and Surette, M. (2002). The dynamic microbe: green fluorescent protein brings bacteria to light. Mol Microbiol 45, 1191-1196.
Stephens, C. (2006) Bacterial cell biology: managing magnetosomes. Curr. Biol. 16, R363-R365.
Van Roessel, P., and Brand, A. (2002). Imaging into the future: visualizing gene expression and protein interactions with fluorescent proteins. Nat Cell Biol 4, E15-E20.
Walker, M., Quinn, T., Kirschvink, J., and Groot, C. (1988). Production of single-domain magnetite throughout life by sockeye salmon, Oncorhynchus nerka. J Exp Biol 140, 51-63.
Yamaoka, T. (2002). Regeneration therapy of pancreatic beta cells: towards a cure for diabetes? Biochem Biophys Res Comm 296, 1039-1043.
Blackwood, K., H. Kong, et al. (2006). In vivo evaluation of thymidine kinase over-expression to track canine bone marrow stromal cells using dual isotope SPECT. Fifth Annual Meeting of the Society for Molecular Imaging. Hawaii, Mol. Imaging. 5: 234.
Chambers, A.F., A.C. Groom, et al. (2002). "Dissemination and growth of cancer cells in metastatic sites." Nat. Rev. Cancer. 2: 563-572.
Goldhawk, D., C. McCreary, et al. (2006). Magnetic resonance imaging of cells overexpressing MagA, an iron transporter involved in magnetosome formation. Fifth Annual Meeting of the Society for Molecular Imaging. Hawaii, Mol Imaging. 5: 294.
Heyn, C., J. A. Ronald, et al. (2006). "In vivo MRI of cancer cell fate at the single-cell level in a mouse model of breast cancer metastasis to the brain." Magn. Reson. Med. 56: 1001-1010.
Jin, Y., H. Kong, et al. (2005). "Determining the minimum number of detectable cardiac-transplanted 111In-tropolone labelled bone-marrow-derived mesenchymal stem cells by SPECT." Phys. Med. Biol. 50: 4445-4455.
Jin, Y. H. Kong, et al. (2006). Cardiac transplanted 111In-tropolone-labelled autologous mesenchymal stem cells: in vivo radiotracer kinetics. Fifth Annual Meeting of the Society for Molecular Imaging. Hawaii, Mol. Imaging. 5: 403.
Komeili, A., Z. Li, et al. (2006). "Magnetosomes are cell membrane invaginations organized by the actin-like protein MamK." Science 311: 242-245.
Matsunaga, T., C. Nakamura, et al. (1992). "Gene transfer in magnetic bacteria: transposon mutagenesis and cloning of genomic DNA fragments required for magnetosome synthesis." J. Bacteriol. 174: 2748-2753.
Prato, F., D. Goldhawk, et al. (2006). Provisional patent U.S. Appl. No. 60/811784. U. S. P. Office. USA.
Stodilka, R., K. Blackwood, et al. (2006). Large animal hybrid SPECT/CT using a small field-of-view gamma camera: proof of principle for monitoring cardiac transplanted stem cells.
Fifth Annual Meeting of the Society for Molecular Imaging. Hawaii, Mol. Imaging. 5: 418.

(56) References Cited

OTHER PUBLICATIONS

Stodilka, R., K. Blackwood, et al. (2006). Performance of hybrid multi-spectral SPECT/CT in tracking transplanted cells in a canine model. Fifth Annual Meeting of the Society for Molecular Imaging. Hawaii, Mol. Imaging. 5: 407.

Tai, J.H., Nguyen, et al. (2006) Imaging pancreatic islet cell gene expression using dual-isotope SPECT/CT. Tenth Annual Meeting of the Canadian Diabetes Association. Toronto.

Pauser et al:"Liposome-encapsulated super-paramagnetic iron oxide particles as markers in an MRI-guided search for tumor-specific drug carriers" Anti-Cancer Drug Design. 1997, vol. 12, No. 2, pp. 125-135. ISSN:0266-9536. See whole document.

Hartung et al : "Labelling of macrophages using bacterial magnetosomes and their characterization by magnetic resonance imaging". In:Journal of Magnetism and Magnetic Materials, Proceedings of the sixth international conference on the scientific and clinical aplications of magnetic carriers, Krems (Austria), 17-120 May 2006. Edited by Use Hafeli and Wolfgang Schutt. Apr. 2007 (available online Dec. 13, 2006 (Dec. 13, 2006)), vol. 311, No. 1, pp. 454-459. ISSN: 0304-8853. See whole document.

Nakamura C et. "An iron-regulated gene, magA, encoding an iron transport protein of *Magnetospirillum* sp. strain AMB-1" The Journal of Biological Chemistry. Nov. 24, 1995 (Nov. 24, 1995), vol. 270, No. 47, pp. 28392-28396. ISSN:1083-351X. See especially abstract, lines 17-19; p. 28395, paragraph titled "Iron Transport in Membrane Visicles,", and figure 6.

Lang C et al: "Biogenic nanoparticles:production, characterization, and application of bacterial magnetosomes" J. Phys.:Condens. Matter. Sep. 2006, vol. 18, No. 38, pp. S2815-S2828. ISSN:0953-8984. See whole document.

Komeili A et al:"Moledular mechanisms of magnetosome formation" Annu. Rev. Biochem 207 (published online Mar. 19, 2007), vol. 76, pp. 351-366. ISSN:0066-4154. See whole document.

Schiller, D. (Apr. 2004-Mar. 2006b). Survey of major projects, In Biannual Report, Research Concept (Max Planck Institute for Marine Biology ), pp. 13-14.

\* cited by examiner

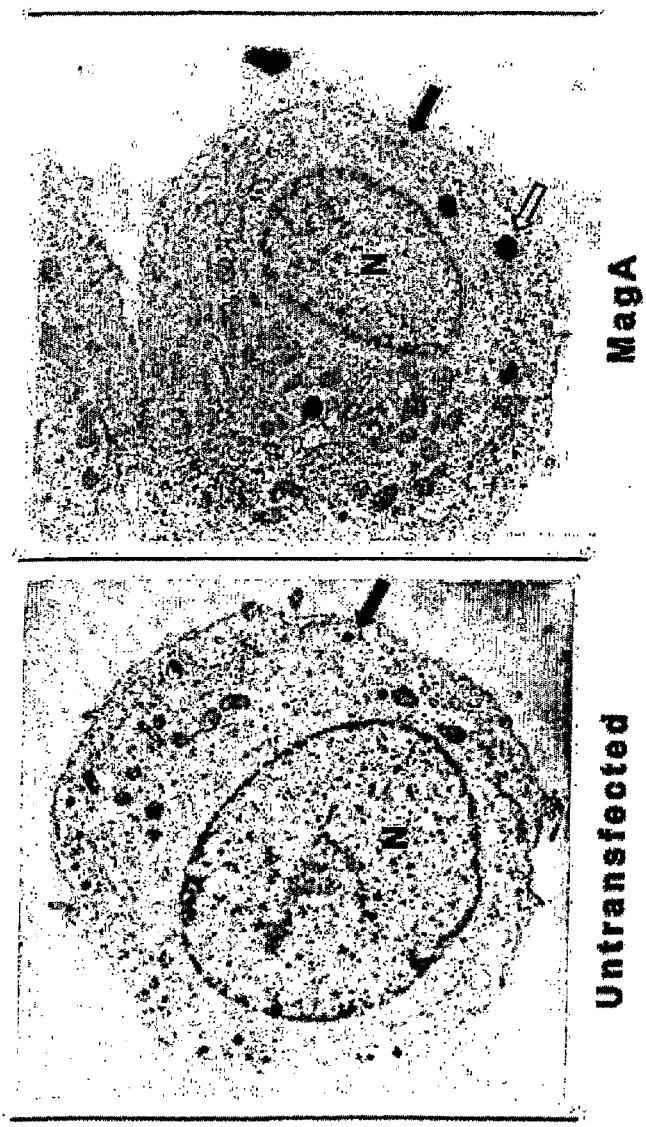

MAGNETOSOME GENE EXPRESSION IN EUKARYOTIC CELLS

The present application claims priority from U.S. Patent Application No. 60/811,784 filed Jun. 8, 2006 and U.S. Patent Application No. 60/879,791 filed Jan. 11, 2007.

FIELD OF INVENTION

The invention relates to the production of magnetosome-like structures in cells. More specifically, the invention provides in vitro and in vivo diagnostic and therapeutic methods using eukaryotic cells expressing magnetosome-like structures that act as contrast agents.

BACKGROUND OF THE INVENTION

Non-invasive mapping of cellular or subcellular events in living organisms, or molecular imaging, is an evolving and largely unexplored field. Magnetic resonance imaging (MRI) is used for in vivo cellular imaging and requires the use of cellular contrast agents. Many of the current developments in contrast agents have revolved around SPIO (super paramagnetic iron oxide) particles. These are specifically formed crystals of a mixture of ferrous and ferric oxides (magnetite). For MRI contrasting, these particles must be as small as possible and yet retain permanent magnetic properties (Bulte et al., 1994). Various companies have developed biologically compatible nanosphere and microsphere SPIO particles. These may be coated with a number of materials including protein, phospholipids, polysaccharide, dextran (Arbab et al., 2003) and silane polymer shells that may or may not further include targeting antibodies. However, they are not useful for long-term studies in which labelled cells divide and the SPIO contrast agent becomes diluted. In addition, SPIO particles alone cannot provide information on cellular and molecular function.

Gene expression systems are under development to couple protein expression with the formation of suitable contrast agents. Adenocarcinoma cells have been transfected with a ferritin gene cloned into a viral expression vector so that the cells will over-express heavy and light ferritin subunits (Genove et al., 2005). Upon culture in iron supplemented media, elevated cellular levels of ferritin provide a sufficient quantity of the crystalline ferrihydrite core for MRI.

Magnetosomes are endogeneous contrast agents that are membrane-bound structures produced by magnetotactic bacteria and contain magnetite or iron oxide mixtures (Bazylinski and Frankel, 2004). Due to their size specificity and distinctive crystal morphology, magnetosomes are good in vivo imaging contrast agents. The full complement of genes responsible for magnetosome synthesis in bacteria is still under investigation (Schüler, et al., 2006; Komeili et al., 2006; Grunberg et al., 2001). Reproducing the entire magnetosome structure in foreign cells has therefore not been accomplished. Current research and development has focussed on the isolation and characterization of the bacterial magnetosome particle (Schuler et al., Max Planck Institute for Marine Biology, Biannual Report, 2004-2006; Herborn et al., 2003).

U.S. Pat. No. 5,861,285 describes a method to make magnetic particles using transformed magnetic bacterium. U.S. Pat. No. 6,033,878 describes a fusion DNA sequence of a protein gene fused to a fragment of a magA gene coding for a protein bound to an organic membrane for covering magnetic particles produced in magnetic bacterium. U.S. Pat. No. 6,251,365 describes a magnetosome surrounded by a phospholipid membrane made by a formation process. U.S. patent application serial no. 2004/0048289 describes a protein specific to a magnetic particle membrane derived from a magnetic bacterium (*Magnetospirillum* sp.) AMB-1.

Magnetite has been reported in the tissue of numerous vertebrates; however, some mollusks and bacteria precipitate this iron mineral. It is the iron crystal that magnetotactic bacteria use to orient themselves in the earth's magnetic field. Crystalline magnetite has not been identified in mammals, nor has a definitive role been demonstrated for magnetosome-like structures in migratory birds. Hence, the role of magnetosomes in vertebrates, including mammals, is still speculative (Kirschvink et al., 2001).

An iron regulated gene, magA, which encodes a membrane-bound, iron-transport protein involved in magnetite synthesis has been identified in *Magnetospirillum* species of bacteria (Bazylinski and Frankel, 2004; Matsunaga et al., 1992; U.S. Pat. No. 6,033,878).

While the prior art has demonstrated that magnetic particles as contrast agents can be made in prokaryotic systems, there still remains a need to develop a method for developing contrast agents in eukaryotic cells for a variety of clinical diagnostic and therapeutic applications.

SUMMARY OF THE INVENTION

The present invention is directed to cells that produce magnetosome-like structures, methods for making such cells and methods for using such cells in a variety of diagnostic and therapeutic methods in vivo, in vitro and ex vivo. For example the invention permits long-term in vivo MRI with enhanced contrast to follow the localization, proliferation and differentiation of transfected cells in tissues and organs as well as image sub-cellular structures in both prokaryotes and eukaryotes. The in vivo tracking of cells, including progenitor cells such as stem cells that differentiate into mature cells with highly specific functions, is a valuable research and clinical tool.

The invention provides constructs comprising one or more magnetosome protein nucleic acid sequences in a vector with suitable inducible promoters. Such constructs can further comprise other genes as desired.

According to an aspect of the present invention is a magnetosome-like structure, said structure being a contrast agent. In aspects, this contrast agent can be used in vitro, in vivo and ex vivo.

According to an aspect of the present invention is a magnetosome-like structure, said structure being isolated from a eukaryotic cell and being a contrast agent for use in MRI.

According to an aspect of the present invention is an eukaryotic cell comprising a magnetosome-like structure that acts as a contrast agent.

According to another aspect of the present invention is an eukaryotic cell comprising an expressible nucleic acid construct, said construct comprising one or more magnetosome protein nucleic acid sequences operatively linked to a promoter.

According to another aspect of the present invention is a cell transfected with a construct comprising a gene selected from a magnetosome gene and/or a magnetosome-associated gene.

According to an aspect of the present invention is a method for making a cell that expresses a magnetosome-like structure as a contrast agent, the method comprising;

transfecting a cell with a construct comprising one or more magnetosome genes under the control of an inducible promoter.

In aspects of the invention, the magnetosome-like structure may be further isolated from the cell.

According to another aspect of the present invention is a method for making a contrast agent in an eukaryotic cell or a non-magnetic prokaryotic cell, said method comprising;

transfecting said cell with a construct comprising one or more magnetosome genes under the control of a promoter.

According to another aspect of the present invention is an ex vivo method for genetically altering stem cells to produce a contrast agent, said method comprising the steps of: maintaining a plurality of undifferentiated embryonic stem cells in vitro in a culture medium said undifferentiated, embryonic stem cells comprising: a mammalian embryonic stem cell which (i) remains uncommitted and undifferentiated while passed in vitro, (ii) is implantable in vivo at a chosen anatomic site as an uncommitted cell, and (iii) engrafts in situ after implantation in a mammal at a local anatomic site, and, (iv) contains a vector comprising a DNA sequence operably linked to a promoter, wherein the DNA sequence encodes a magnetosome protein; and subsequently culturing said embryonic stem cells for a predetermined time in a culture media to yield a cellular inoculum comprising cells in which differentiation has been initiated.

In aspects of the invention, the cellular inoculum is administered to a recipient to a desired location and can be subjected to MRI to track the differentiation of the stem cells in vivo.

According to a further aspect of the present invention is a method for genetically altering undifferentiated stem cells so that they contain a magnetosome-like structure comprising a dense core vesicle that acts as a contrast agent, said method comprising;

transfecting said stem cell with a nucleic acid sequence encoding one or more magnetosome proteins under the control of a suitable promoter.

According to another aspect of the present invention is the use of a cell containing a magnetosome-like structure in a diagnostic or therapeutic method to locate and/or track the cell in vitro or in vivo.

According to another aspect of the present invention is eukaryotic cell comprising a recombinant magnetosome-like structure.

According to a further aspect of the present invention is a transformed eukaryotic host cell comprising a plasmid expressing one or magnetosome genes. In aspects of the invention the host cell can be a non-magnetic prokaryotic cell.

Other features and advantages of the present invention will become apparent from the following detailed description. It should be understood, however, that the detailed description and the specific examples while indicating embodiments of the invention are given by way of illustration only, since various changes and modifications within the spirit and scope of the invention will become apparent to those skilled in the art from the detailed description.

BRIEF DESCRIPTION OF THE DRAWINGS

The present invention will become more fully understood from the detailed description given herein and from the accompanying drawings, which are given by way of illustration only and do not limit the intended scope of the invention.

Magnetosome gene expression in eukaryotic cells was carried out using standard transfection procedures. The production of dense core vesicles used magnetosome genes and the cell's endogenous machinery to amplify magnetite formation.

Figure 1A:
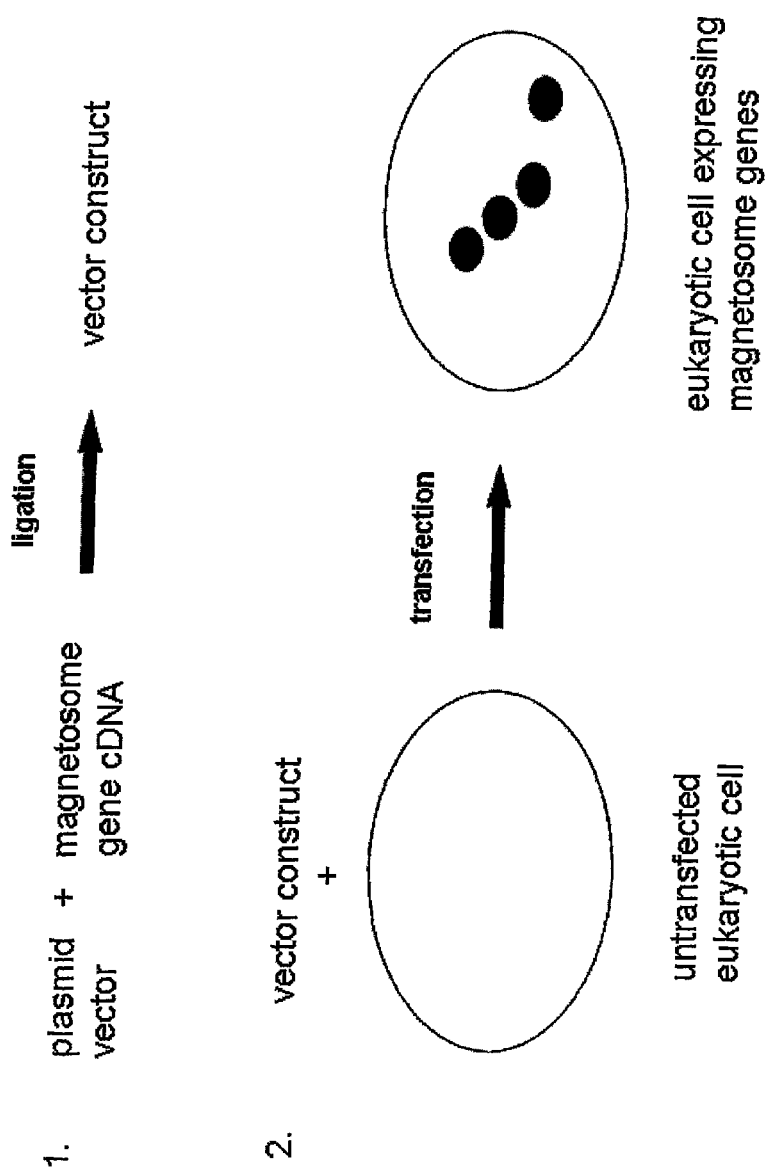
FIG. 1A shows the transfection of eukaryotic cells with magnetosome gene(s).
Figure 1B:
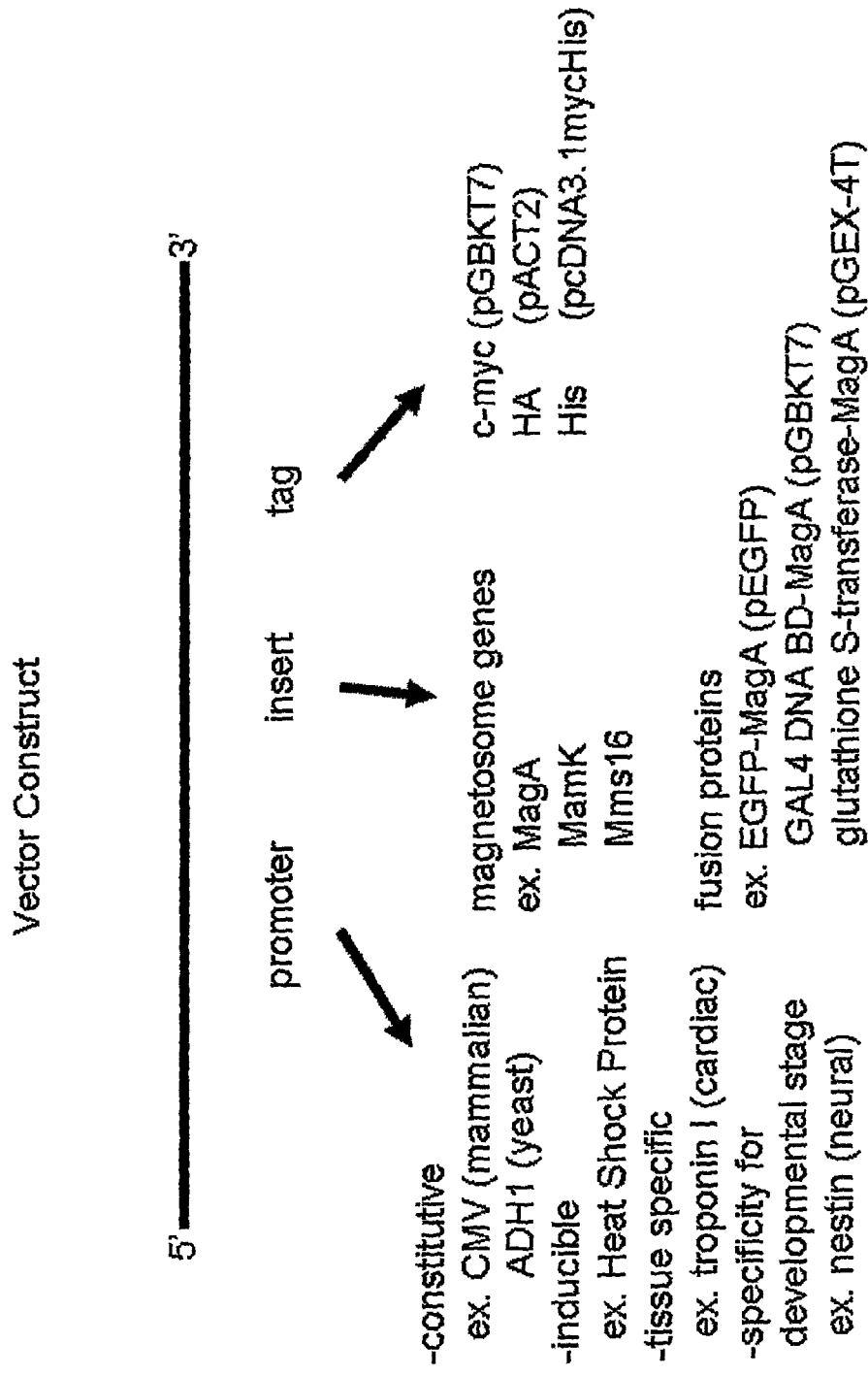

FIG. 1B shows the vector constructs. Eukaryotic expression vectors were designed with promoter sequences and magnetosome cDNA insert. Overexpressed protein was tagged by fusion with marker proteins, such as EGFP, or small peptide epitopes, such as c-myc, hemaglutinin (HA), or polyhistidine (His).

Figure 2A:
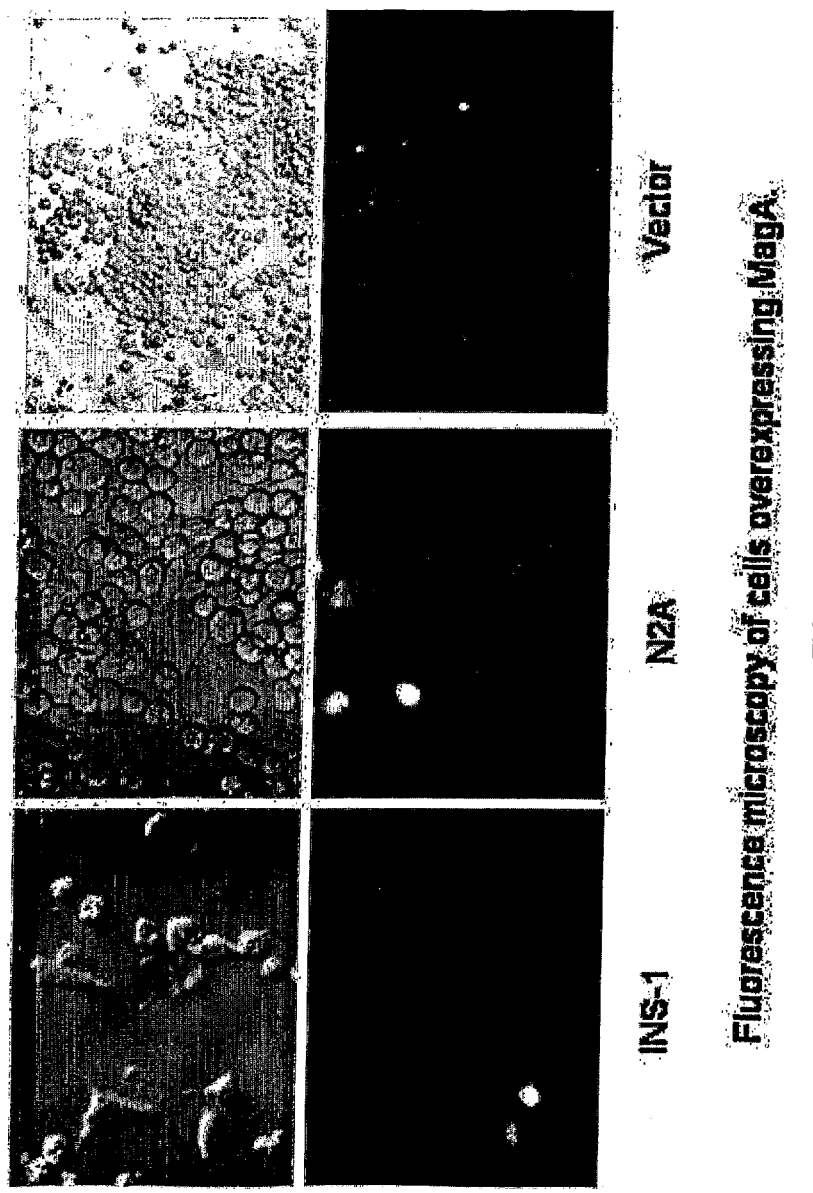

FIG. 2A shows fluorescence microscopy of cells overexpressing MagA. The fluorescence micrographs show INS-1 and N2A cells transfected with MagA in pEGFP. The vector control is depicted in N2A cells. Bright field images show cells under Hoffman Modulation Contrast optics. Cells expressing MagA are ×400. The vector control is ×100.

Figure 2B:
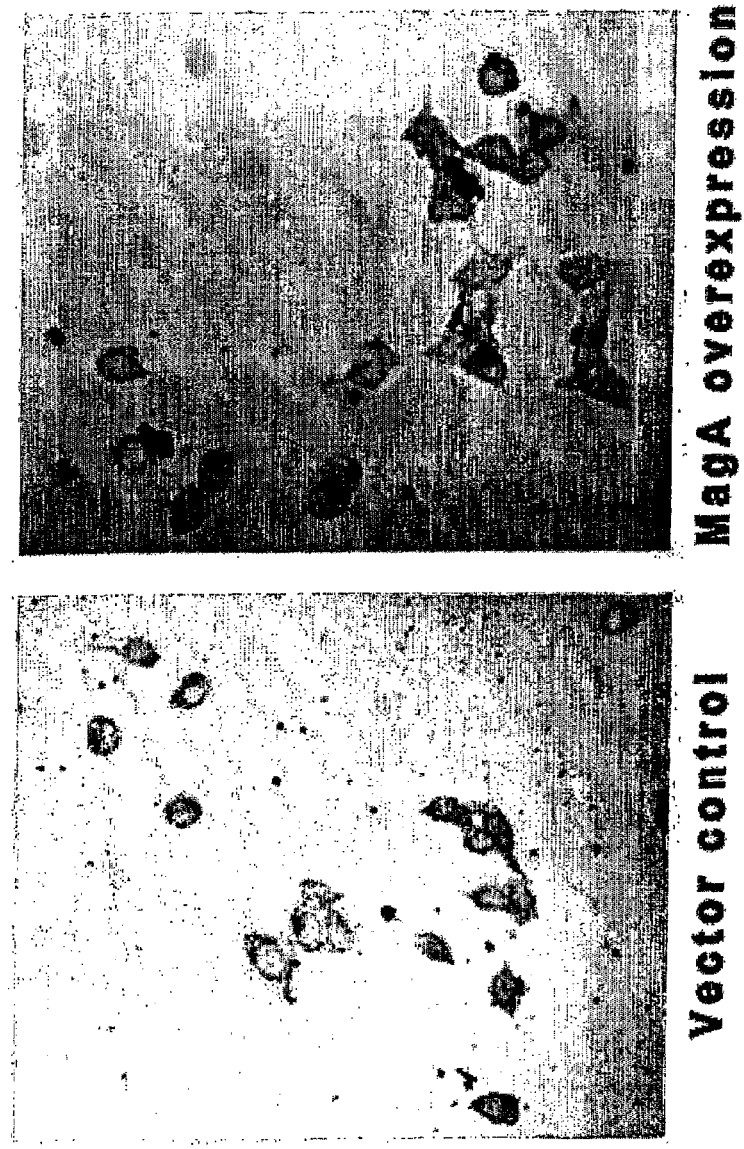

FIG. 2B shows prussian blue staining of INS-1 cells. Beta cells were transfected with pEGFP, with and without a MagA cDNA insert. Following transfection, cells were cultured in media supplemented with 250 μM ferric nitrate. Prussian blue staining of transfected cells indicates the degree of iron loading.

Figure 2D:
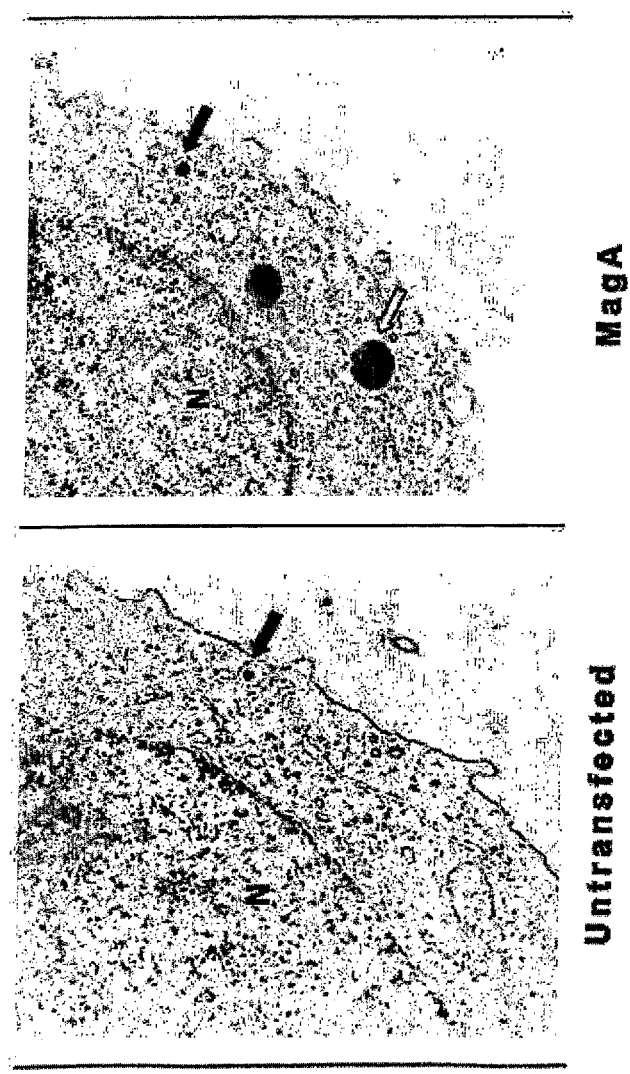

FIG. 2C, 2D show scanning electron micrographs of INS-1 cells. The electron micrographs of beta cells show differences in subcellular morphology depending on the expression of EGFP-MagA. The untransfected sample exhibits typical islet cell structure, including insulin secreting vesicles (filled arrows). MagA expressing cells show additional dense core vesicles (open arrow) that are distinct from insulin secretory vesicles and not detected in untransfected cells. Magnification is approximately ×18,000 (C) and ×40,000 (D). N, nucleus.

Figure 2E:
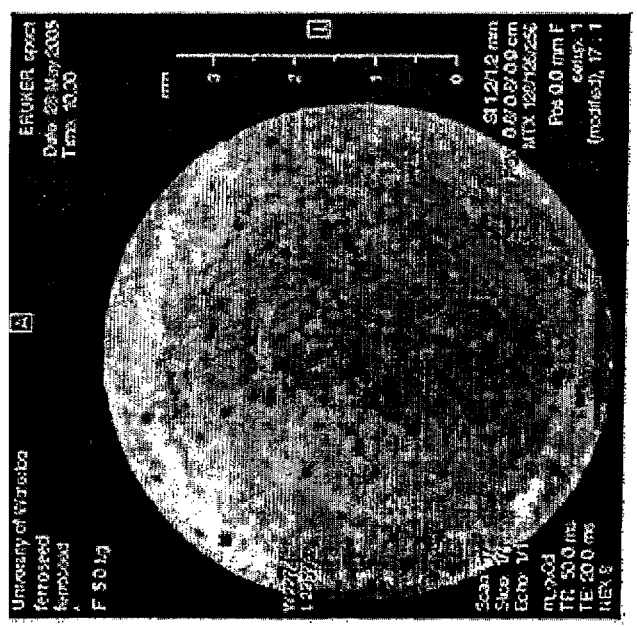

FIG. 2E shows MR imaging of INS-1 cells transfected with MagA. Transfected cells were examined by MRI using a simple Gradient Echo with a TE of 20 ms and showed some areas of signal loss.

Figure 3:
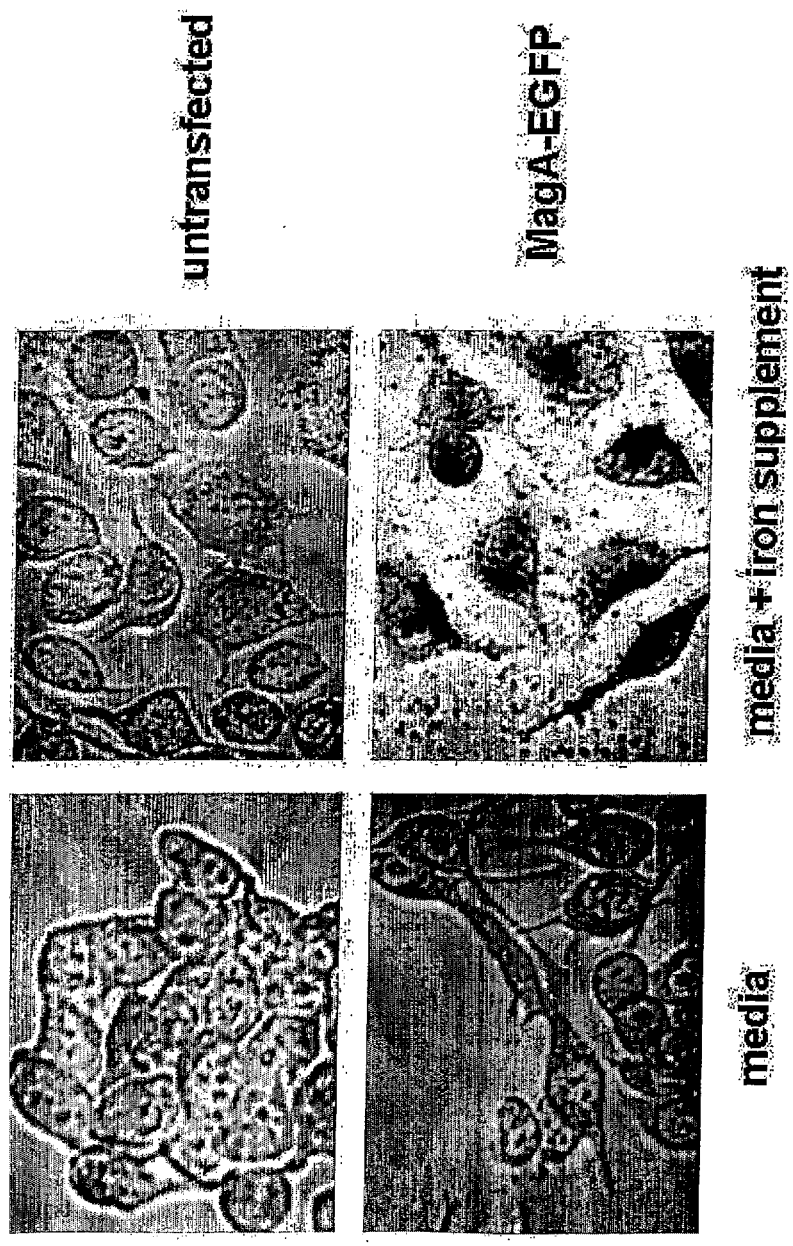

FIG. 3 shows Prussian blue staining of N2A cells transfected with MagA-EGFP where the culture media was supplemented with ferric nitrate.

Figure 4:
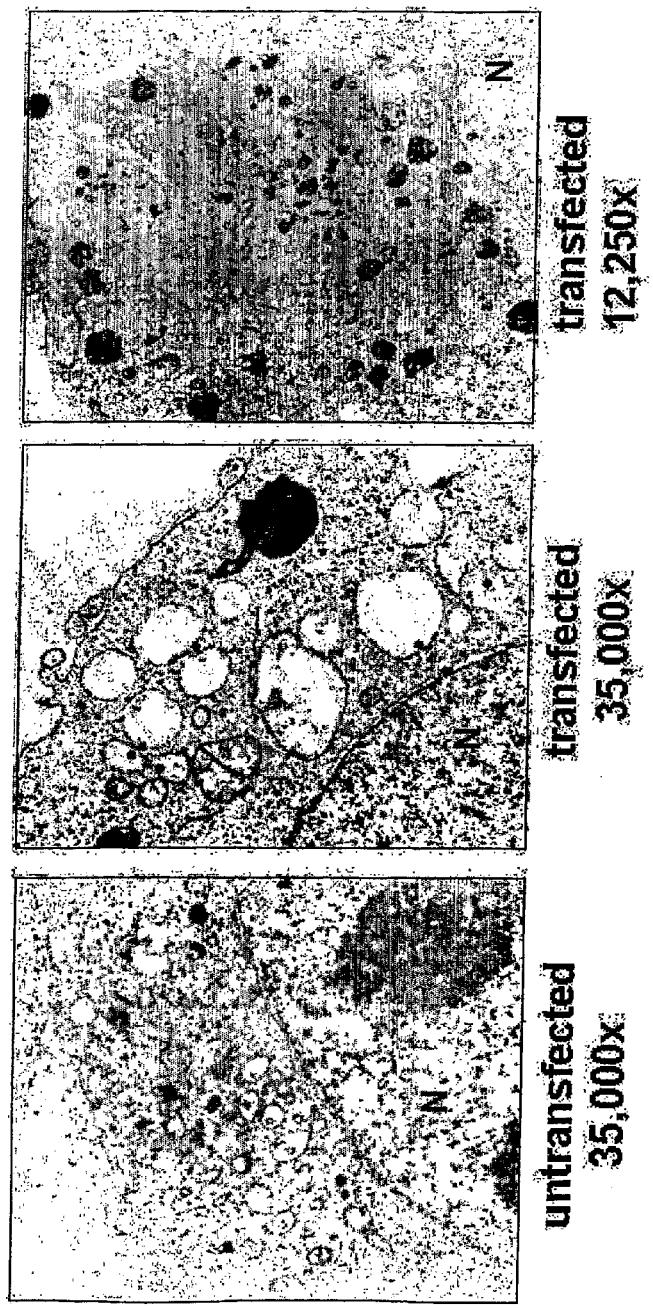

FIG. 4 shows the ultrastructure of MagA-EGFP overexpressing N2A cells by transmission electron microscopy. N=nucleus.

Figure 5:
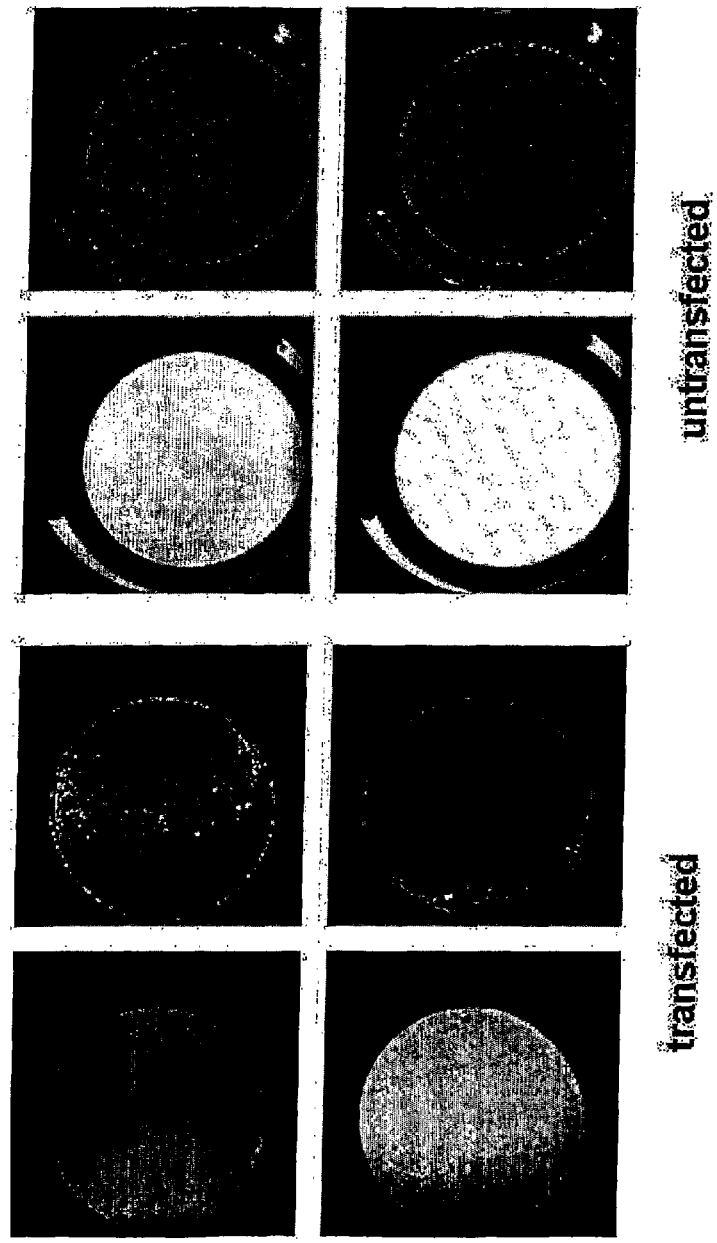

FIG. 5 shows MR imaging of N2A cells expressing MagA.

Figure 6:
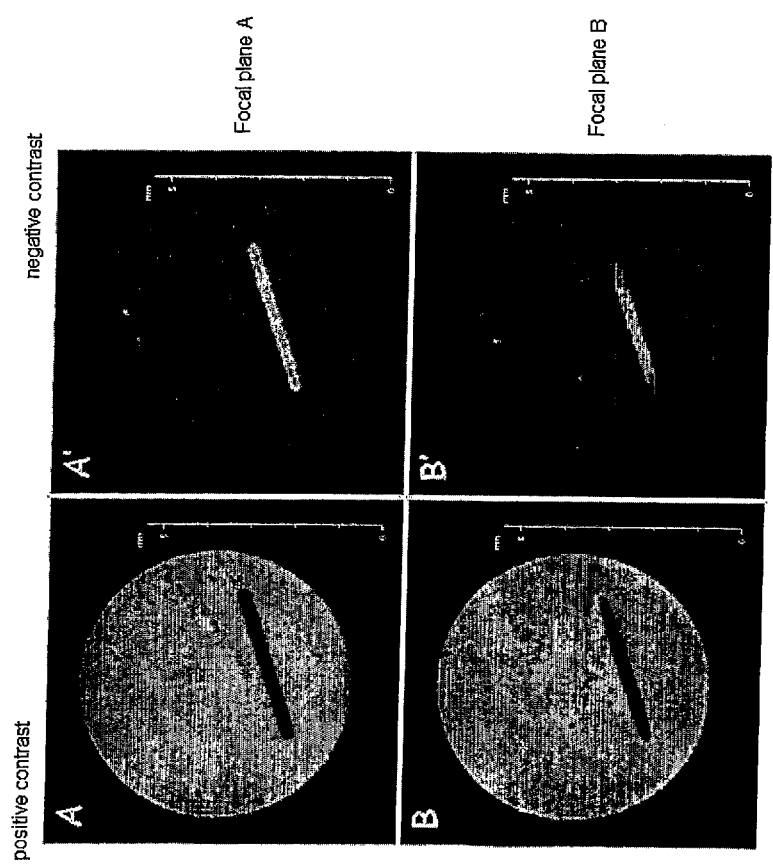

FIG. 6 shows a further example of MR imaging of N2A cells expressing MagA. Positive (A,B) and negative (A',B') images show areas of signal loss in two adjacent planes of focus. A and A' are both from one plane of focus, while both B and B' are a second plane of focus. A human hair marks the plane of focus. The image resolution is 65×65×125 cubic micrometer.

Figure 7A:
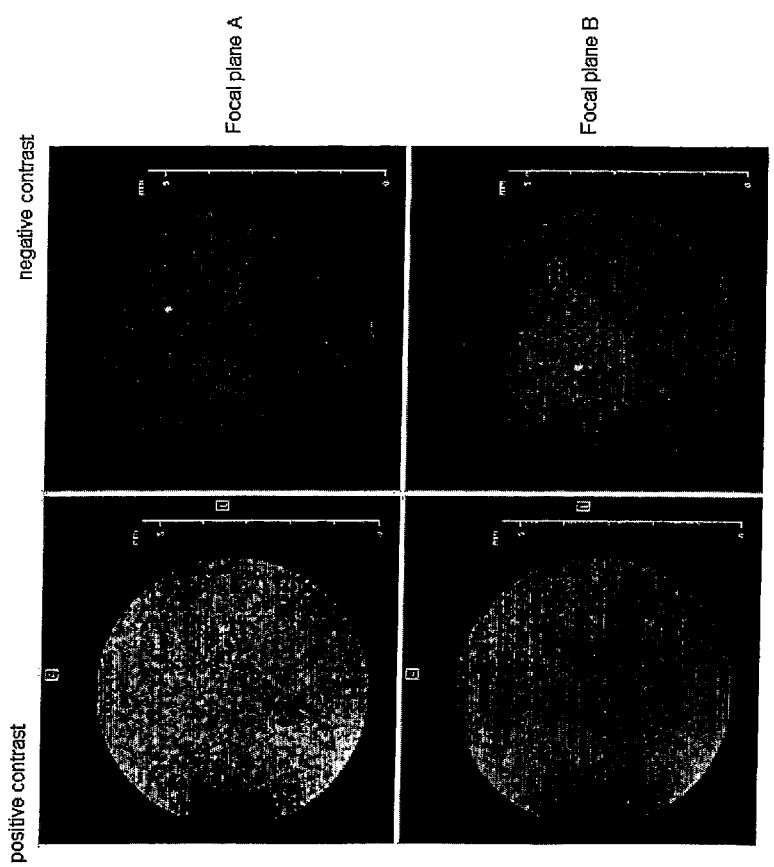
Figure 7B:
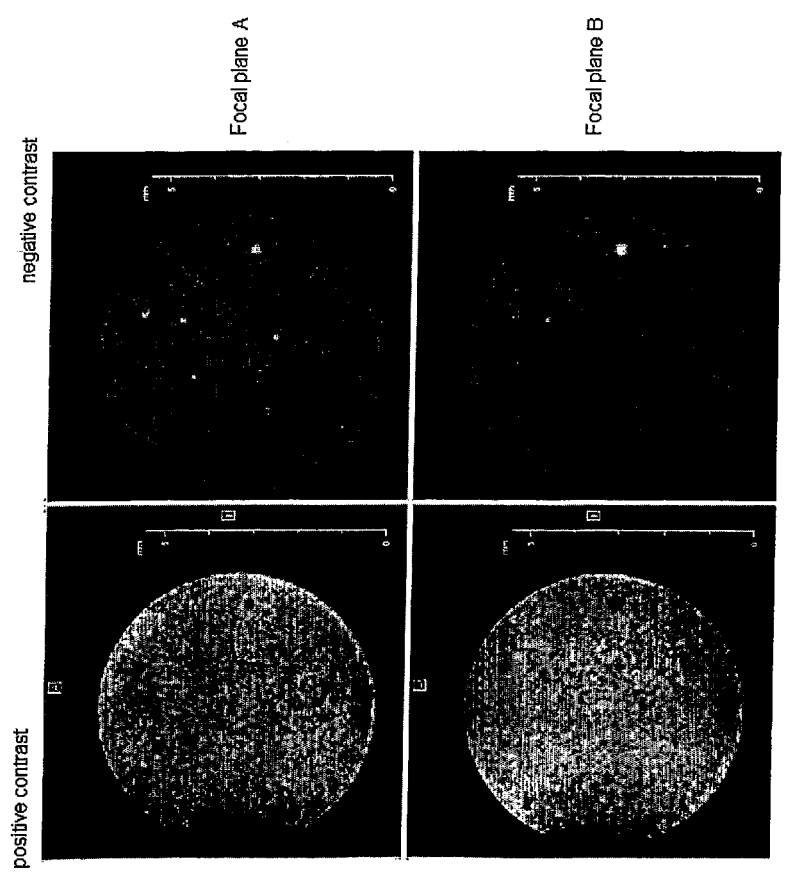
Figure 7C:
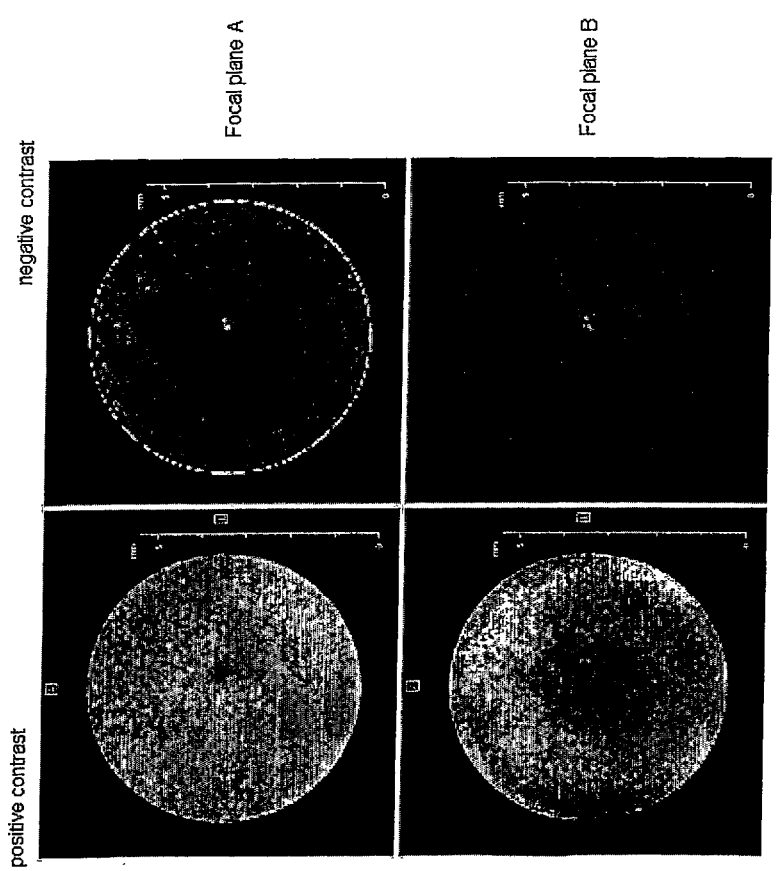
Figure 7D:
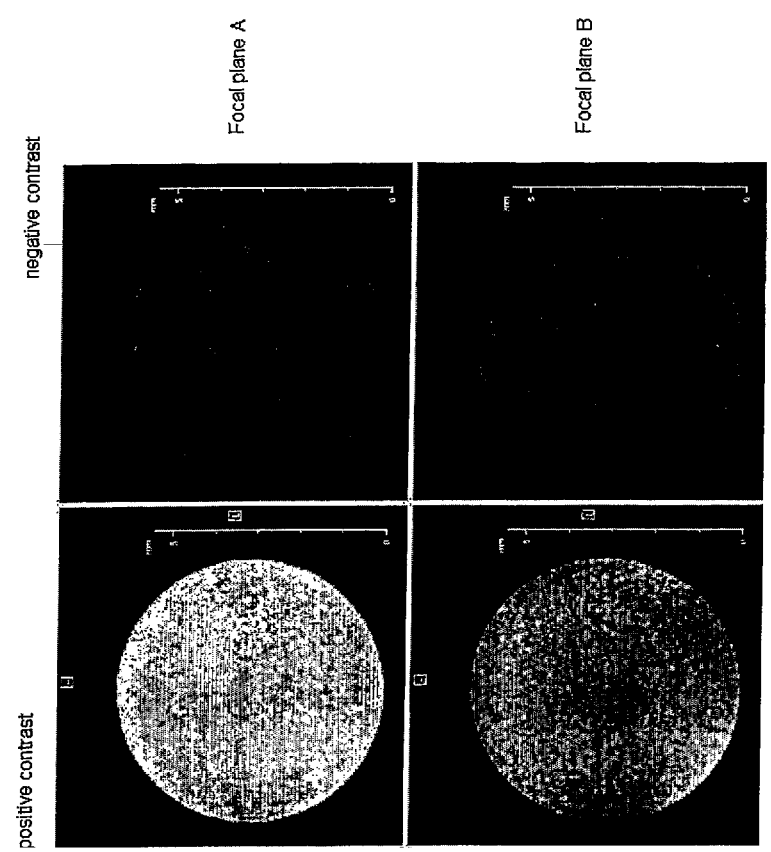
Figure 7E:
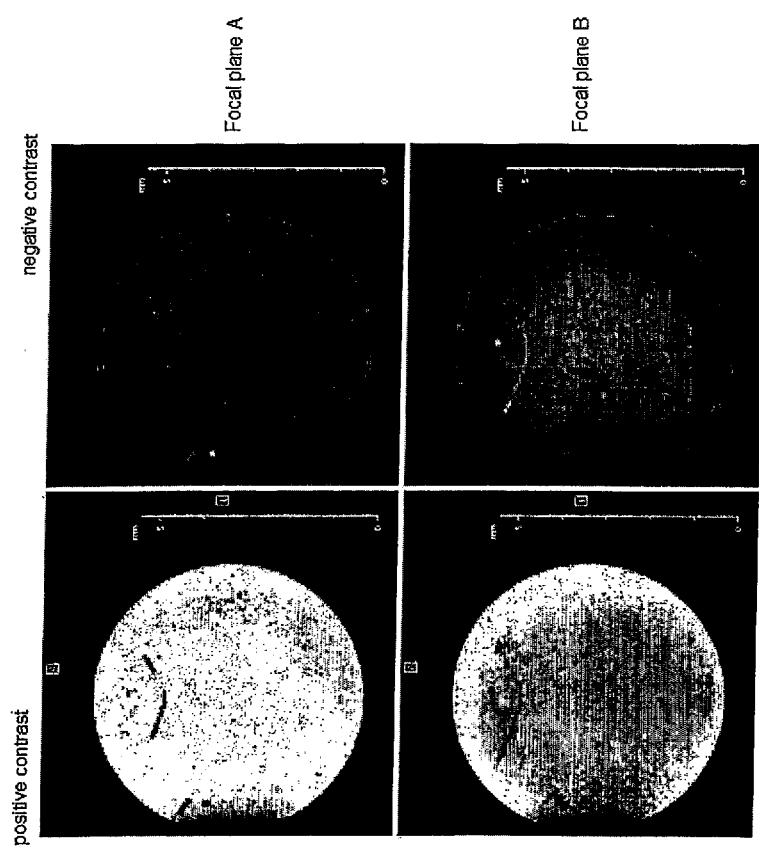
Figure 7F:
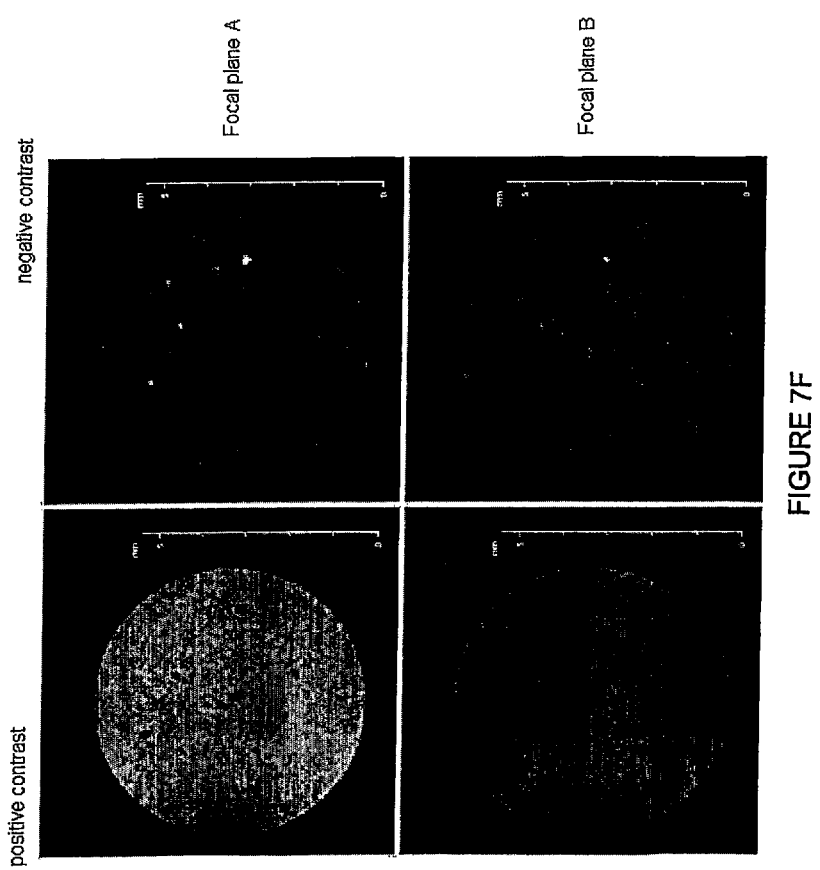
Figure 7G:
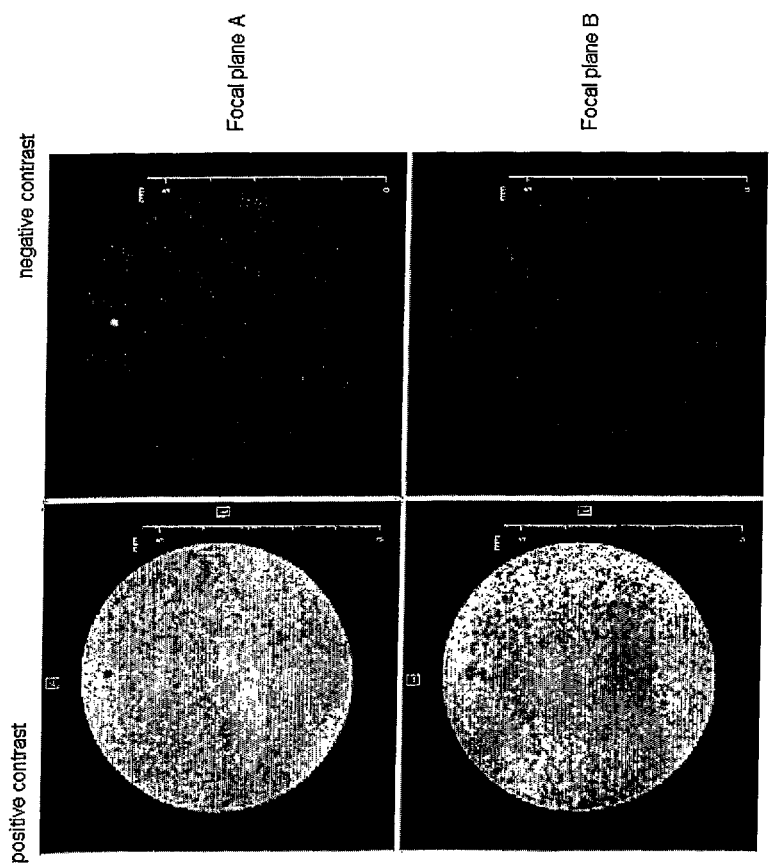
Figure 7H:
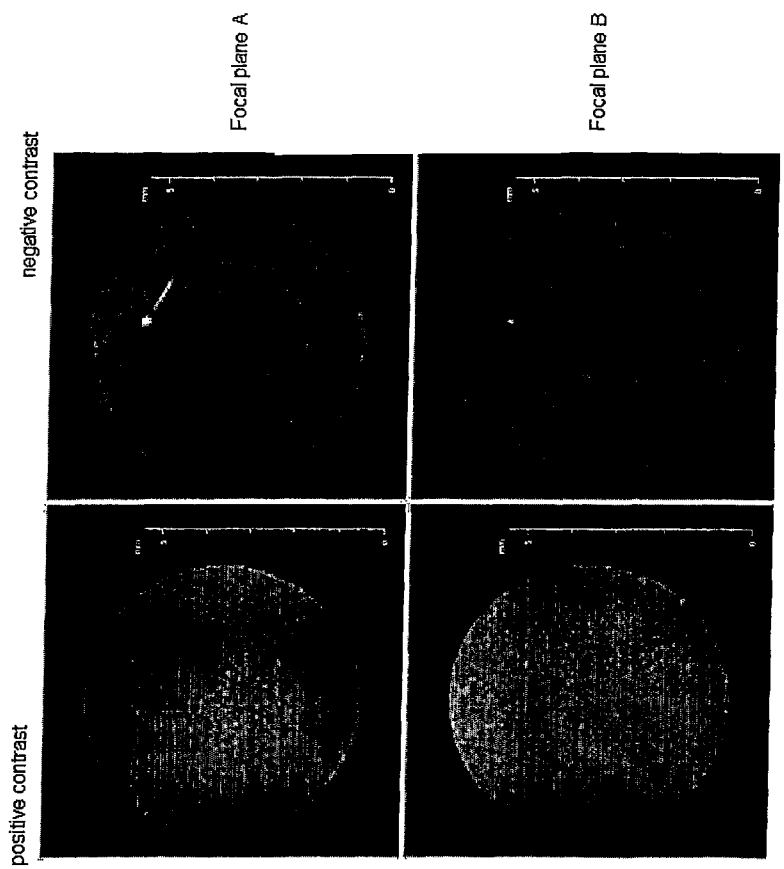

FIGS. 7A-7H show yet further examples of MR imaging of N2A cells expressing MagA. Positive and negative images are shown for two adjacent planes of focus. In FIGS. 7E and 7H a human hair marks the plane of focus.

Figure 8A:
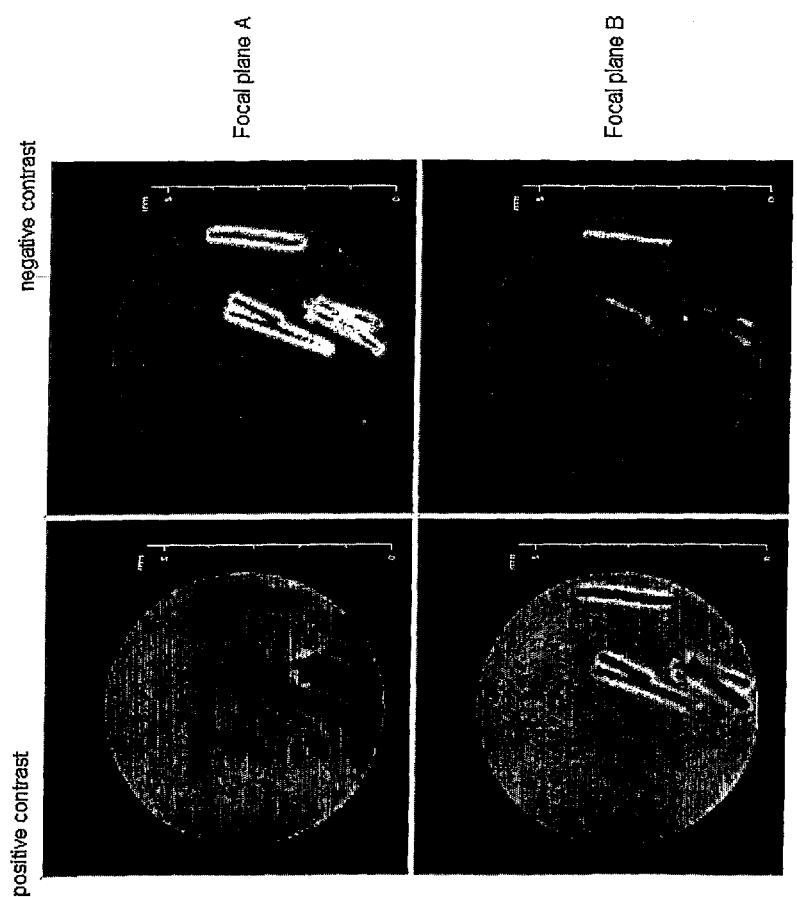
Figure 8B:
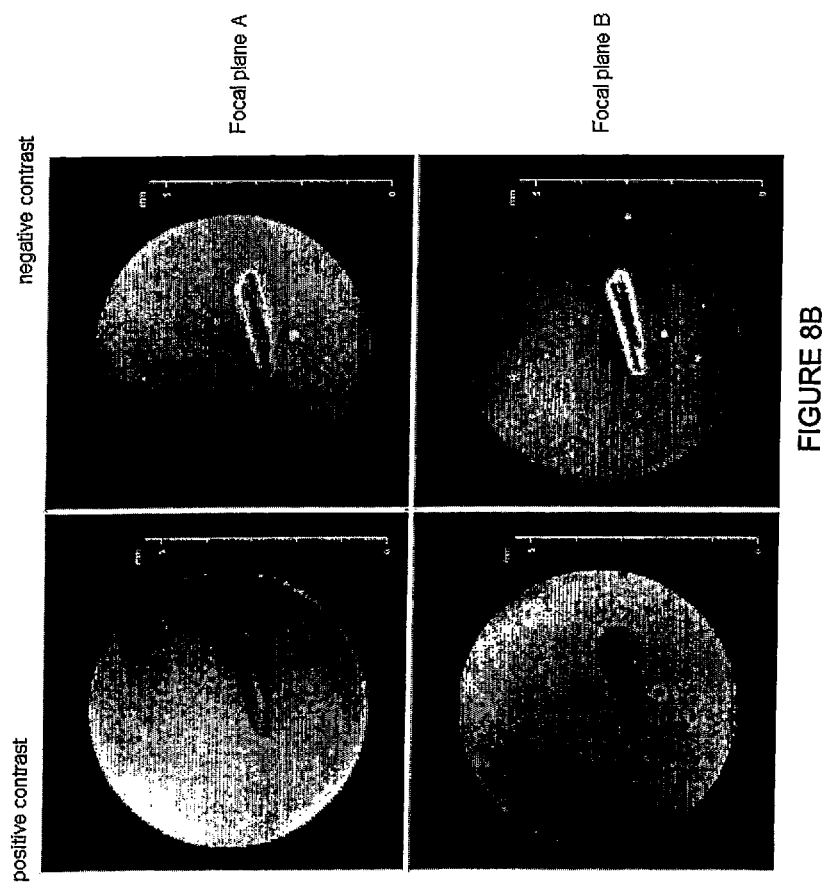
Figure 8C:
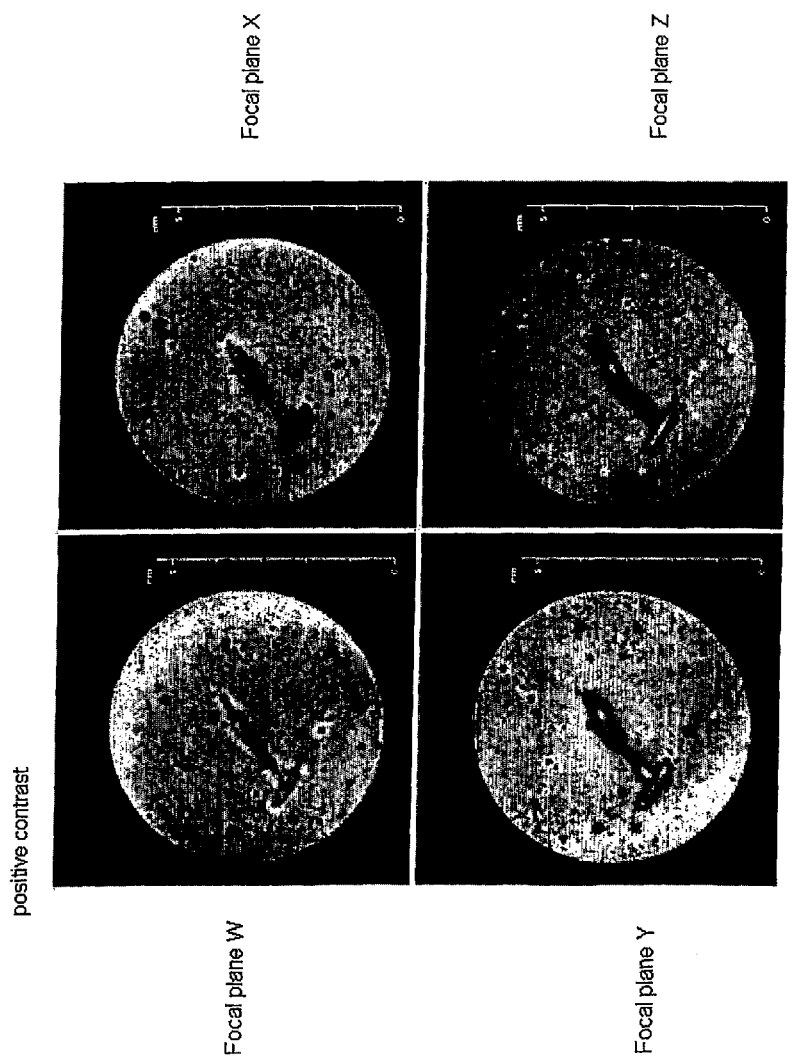
Figure 8D:
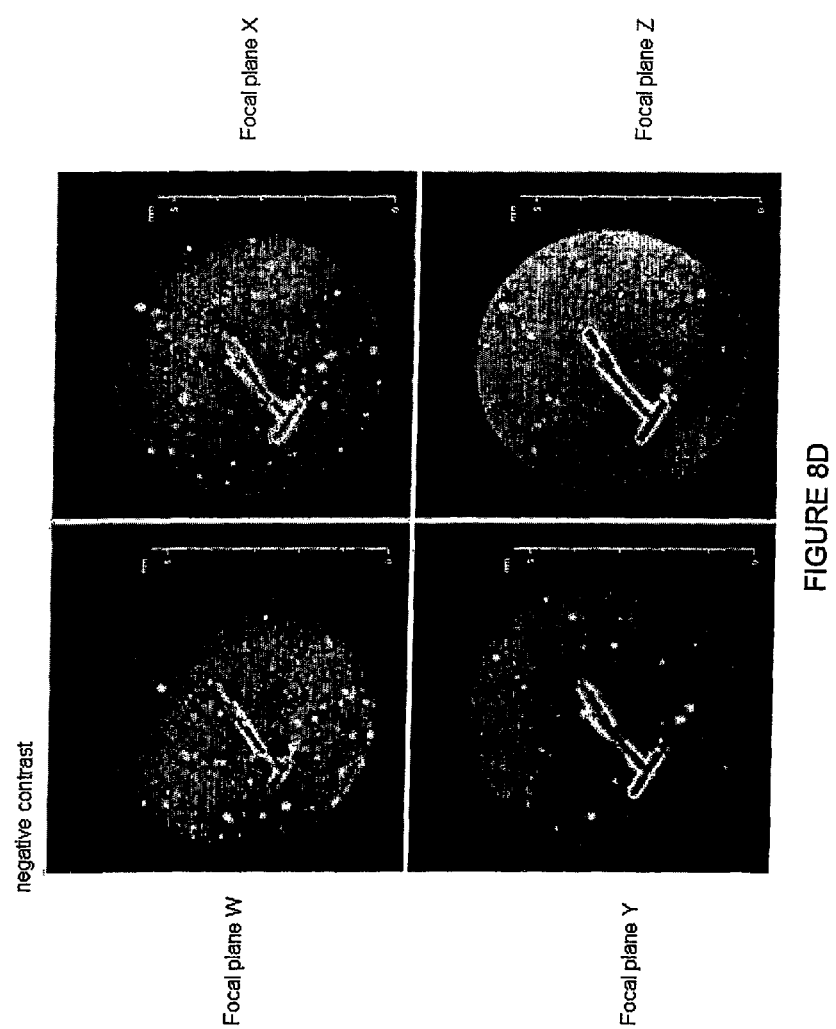
Figure 8E:
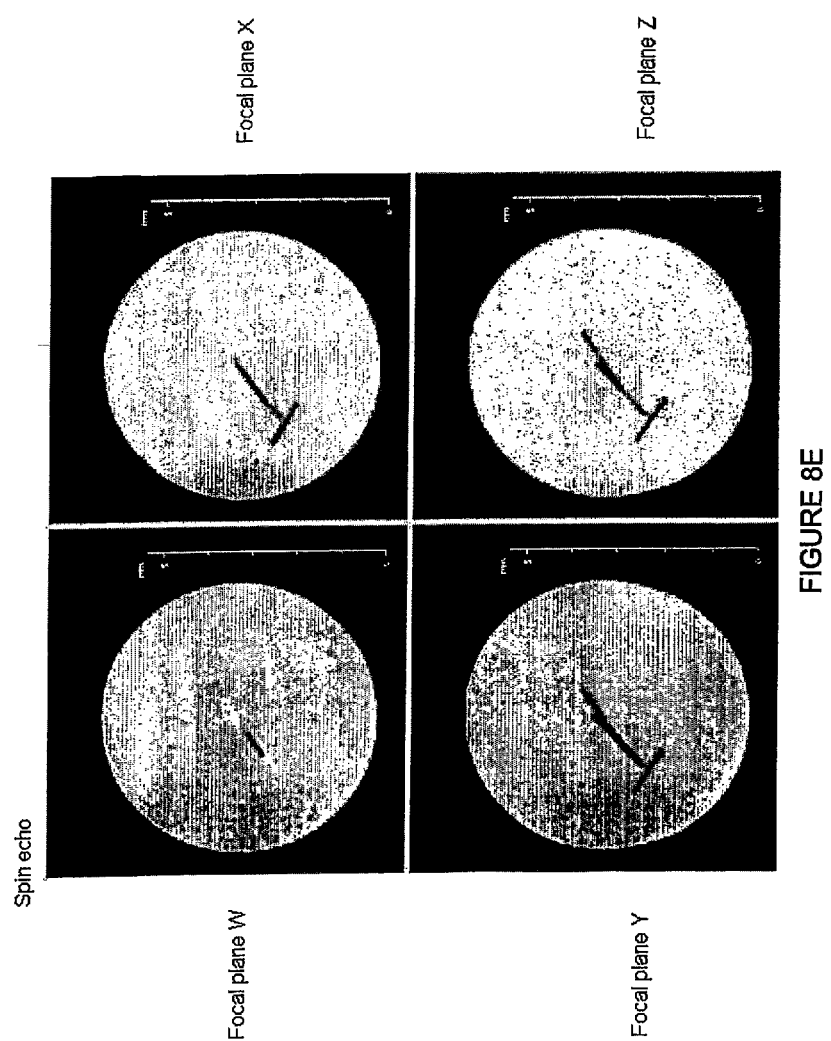

FIGS. 8A-8E show different images pertaining to still a further MagA expression demonstration. FIG. 8A shows MR imaging of a gelatin mold alone in the absence of cells, in positive and negative contrast images, at 2 different focal planes. FIG. 8B shows the background provided by 1 million cells expressing vector alone without MagA, in positive and negative contrast images, at 2 different focal planes. FIGS. 8C, 8D, and 8E pertain to cells comprising a vector with MagA insert. FIGS. 8C and 8D each show 4 different focal planes (W, X, Y, Z) in positive contrast and negative contrast images, respectively, while FIG. 8E shows spin echo imaging at these 4 focal planes. Spin echo imaging sequences at each focal plane indicate that signal voids cannot be attributed to air pockets. Human hair marks the focal plane.

DETAILED DESCRIPTION OF THE
PREFERRED EMBODIMENTS

An aspect of the invention provides genetically engineered cells that produce magnetosome-like structures as contrast agents for mapping and/or imaging of organs, tissues, cells, sub-cellular structures, proteins and peptides in living organisms both in vivo and in vitro. The method of the invention genetically alters cells to produce magnetosome-like structures as large dense core vesicles that form MR contrast agents in the cell. Certain aspects of the invention also provide magnetosome gene constructs that may be expressed from vectors bearing inducible promoters or encoding other useful genes for targeting cells or for therapeutic treatments that can be followed by functional imaging or long-term tracking of transfected cells. As such, various cell processes, for example, cellular migration, proliferation, differentiation and apoptosis can be tracked using the present invention.

Magnetosome-like structures typically comprise iron-containing particles enclosed within membrane vesicles. In naturally-occurring instances in bacteria, magnetosomes have been shown to contain crystalline particles of magnetite ($Fe_3O_4$) or greigite ($Fe_3S_4$). Most magnetotactic bacteria produce crystals of magnetite. Characterization of iron-containing particles that are incorporated into magnetosomes are discussed in several articles; for example, Stephens (2006) and Schuler (2004). Without wishing to be bound by theory, while the mechanism of magnetite biomineralization is not completely understood (Schuler, 2004), it is proposed to involve the uptake of ferric ion ($Fe3+$). This is also the species of iron bound by the transferrin receptor in mammalian cells.

A beneficial feature of the present invention is the fact that the genetically altered cells of the invention can continue to express magnetosome genes and produce magnetosome-like structures in vivo during growth, differentiation and/or replication of the cell. As a result such cells can be visually tracked as they grow, differentiate and/or replicate inside a host while maintaining detectable levels of magnetosome-like structures, and in certain examples without dilution of the magnetosome-like structure. Therefore, these structures may provide long-term in vivo contrast agents in a wide variety of cells, tissues, organs, etc.

In aspects of the invention the cells are non-magnetic prokaryotic cells or any type of eukaryotic cell capable of expressing a bacterial magnetosome gene. Any type of mammalian cell is suitable for use in the present invention for production of a magnetosome-like structure. For example, any human cell type that is useful for diagnostic, therapeutic or research purposes may be modified to express magnetosome gene(s) and produce magnetosome-like structures. Non-limiting examples of human cells that have been used for research purposes are MCF-7 (breast cancer), MDA-MB-438 (breast cancer), U87 (glioblastoma), A172 (glioma), HeLa (cervical cancer), HL60 (promyelocytic leukemia), A549 (lung cancer), HEK 293 cells (kidney), SHSY5Y (neuroblastoma cells, cloned from a myeloma), Jurkat (derived from a patient with T cell leukemia). Mammalian cells other than human cells may be used, for example without limitation, rat, mouse, dog, horse, pig, or non-human primate cells. Non-limiting examples of non-human mammalian cells are Vero (African green monkey Chlorocebus kidney), COS-7 (African Green Monkey Kidney), GH3 (rat pituitary tumor), 9 L (rat glioblastoma), MC3T3 (mouse embryonic calvarial), C3H-10T1/2 (mouse embryonic mesenchymal), NIH-3T3 (mouse embryonic fibroblast). Animal cells, other than mammalian cells, are also contemplated including, without limitation, bird, fish, insect, or reptile cells. Even further eukaryotic cells, other than animal cells, are contemplated, for example plant cells.

Recombinant cells, comprising a magnetosome nucleic acid sequence may be advantageously used in the recombinant production of magnetosome-like structures. Recombinant magnetosome-like structures are magnetosome-like structures that do not naturally occur in a eukaryotic cell in that they may comprise a magnetosome protein or their formation may be directed by a magnetosome protein that does not naturally occur in the eukaryotic cell.

In certain aspects of the invention, a cell may be altered or modified to express a magnetosome gene encoding a magnetosome protein that does not naturally occur in the cell, and as such the cell will be considered recombinant. As is understood by one of skill in the art, a magnetosome gene May be introduced into a cell using any known technique, for example, microinjection, electroporation, viral transfection, lipofectamine transfection, calcium phosphate precipitation and the like. In certain non-limiting examples, cells may be isolated from a eukaryotic organism, modified by introduction of a magnetosome gene, and then the modified cells may be administered or inserted in a desired location in the subject. In certain other examples, a magnetosome gene may be incorporated into an appropriate construct or vehicle, for example a viral construct, and administered or inserted in a desired location in a eukaryotic subject such that the magnetosome gene(s) is introduced and expressed in at least a portion of the cells of the subject. A magnetosome gene can include but is not limited to MagA (an iron transport gene disclosed in U.S. Pat. No. 5,861,285, the disclosure of which is incorporated herein in its entirety), MamK (a gene responsible for organizing magnetosome chains; see for example, Komeili et al. (2006) or Stephens (2006)) and MMS16 (a gene responsible for function as it involves GTPase activity; see for example, Okamura et al. (2001) or Schuler (2004)). One or more magnetosome nucleic acid sequences (for example, genomic, cDNA or functional portions thereof) can be used in the present invention as well as magnetosome-associated genes. A number of magnetosome genes can be introduced into a cell, either singly or in combination, to optimize the formation of magnetosome-like structures for use as a contrasting agent. Furthermore, magnetosome genes and magnetosome-associated genes for use in the invention can be mutated or altered prior to transfection into the cells as desired, for example for codon optimization for expression in mammalian cells. Magnetosome genes and magnetosome-associated genes can be made as fusion proteins as desired in an application, for example fusion with a targeting peptide or a therapeutic peptide.

A magnetosome nucleic acid may be any nucleic acid molecule of, for example. cDNA, genomic DNA, synthetic DNA or RNA origin or suitable combinations thereof and which may be based on a complete or partial naturally occurring nucleic acid sequence encoding a magnetosome protein. A magnetosome protein may be any protein of, for example, recombinant or synthetic origin or suitable combinations thereof and which may be based on a complete or partial naturally occurring amino acid sequence encoding a magnetosome protein. A magnetosome nucleic acid or protein may be mutated or changed or derivatised in any manner desired (for example, deletion, insertion, substitution) to produce a variant. Use of such variants in producing magnetosome-like structures is contemplated, and such a variant nucleic acid or variant protein may be mutated or changed or derivatised in any manner in comparison to a naturally occurring magnetosome nucleic acid or protein, respectively, provided that the capability of forming magnetosome-like structures is maintained. Similarly, magnetosome nucleic acids or magnetosome proteins having varying degrees of sequence identity to a corresponding naturally occurring magnetosome nucleic acid or protein sequence may be tolerated without eliminating the activity of forming magnetosome-like structures. For example, a recombinant eukaryotic cell may comprise a recombinant bacterial magnetosome protein having a sequence that is identical to a naturally-occurring form of the bacterial magnetosome protein or a variant thereof that has a sequence that is at least 80% identical to a naturally-occurring form of the bacterial magnetosome protein. As another example, a recombinant eukaryotic cell may comprise a recombinant bacterial magnetosome nucleic acid having a coding sequence that is identical to a naturally-occurring form of the bacterial magnetosome gene or a variant thereof that has a sequence that is at least 70% identical to a naturally-occurring form of the bacterial magnetosome gene. Determination of sequence identity of proteins and nucleic acids by computer based methods, as well as nucleic acid hybridization techniques for determining or identifying sequences that share high (eg., at least 70%) sequence identity are well known to the skilled person. Magnetosome genes have been cloned and sequenced from various sources and have been shown to maintain biological activity over varying degrees of sequence identity. For example, nucleic acids encoding MagA have been cloned from a variety of sources. Table 1 identifies by accession number, several non-limiting examples of MagA sequences and shows a comparison of sequence identity.

A magnetosome nucleic acid may be operably linked to control sequences, typically in the context of a suitable vector. A useful control sequence may be any nucleic acid element that is necessary or advantageous for expression of the coding sequence of the nucleic acid sequence. Each control sequence may be native or foreign to the nucleic acid sequence encoding the magnetosome protein. Such control sequences include, but are not limited to, a leader, a polyadenylation sequence, a propeptide sequence, a promoter, a signal sequence, or a transcription terminator. A suitable vector may be any vector (for example, a plasmid or virus) which can incorporate a magnetosome nucleic acid and any desired control sequences and can bring about the expression of the magnetosome nucleic acid sequence. The choice of the vector will typically depend on the compatibility of the vector with a host cell into which the vector is to be introduced. In certain examples, the vector may exist as an extrachromosomal entity, with replication being independent of chromosomal replication, for example, a plasmid, an extrachromosomal element, a minichromosome, or an artificial chromosome. In other examples, the vector may be one which, when introduced into the host cell, is integrated into the genome and replicated together with the chromosome(s) into which it has been integrated. Still other examples of vectors will be known and apparent to the skilled person.

In aspects of the invention, MagA expression in mammalian cells is correlated with an increase in cytoplasmic, dense core vesicles. MagA expression enhances the cellular uptake of iron and MagA expression facilitates cellular detection by MRI.

Furthermore, useful proteins such as enzymes and antibodies can be bound to the magnetosome-like structures. When the useful protein is a functional protein, the functional protein immobilized on the magnetosome-like structures can be magnetically controlled. Thus the function can be efficiently performed at a desired position.

TABLE 1

Examples of MagA encoding sequences

| Accession | Description | Max score | Total score | Query coverage | E value | Max ident |
|---|---|---|---|---|---|---|
| AB001696.1 | *Magnetospirillum magneticum* gene for MagA protein, complete cds, strain: AMB-1, clone: 3 | 2422 | 2422 | 100% | 0.0 | 100% |
| AP007255.1 | *Magnetospitillum magneticum* AMB-1 DNA, complete genome | 2194 | 2194 | 99% | 0.0 | 97% |
| D32253.1 | *Magnetospitillum magneticum* genes for MagA and hypothetical protein, complete cds, strain: AMB-1 | 2194 | 2194 | 99% | 0.0 | 97% |
| AB001694.1 | *Magnetospitillum magneticum* gene for MagA protein, complete cds, strain: AMB-1, clone: 10 | 2167 | 2167 | 100% | 0.0 | 96% |
| AB001698.1 | *Magnetospitillum magneticum* gene for MagA protein, complete cds, strain: MGT-1 | 1751 | 1751 | 100% | 0.0 | 90% |
| AB001699.1 | *Magnetospirillum magnetotacticum* gene for MagA protein, complete cds, strain: MS-1 | 1546 | 1546 | 100% | 0.0 | 88% |
| AF257521.1 | *Magnetospirillum magnetotacticum* MagA gene, complete cds; and RNaseHII gene, partial cds | 1541 | 1541 | 99% | 0.0 | 88% |
| AB001695.1 | *Magnetospitillum magneticum* gene for MagA protein, complete cds, strain: AMB-1, clone: 141 | 933 | 986 | 46% | 0.0 | 100% |
| AB001697.1 | *Magnetospitillum magneticum* gene for MagA protein, partial cds, strain: AMB-1, clone: 46 | 917 | 917 | 41% | 0.0 | |

In a non-limiting embodiment of the invention magA cDNA was obtained from the freshwater bacterium *Aquaspirillum* strain AMB-1 and cloned into suitable mammalian plasmid vectors using standard procedures. Magnetosome nucleic acid sequences may be expressed from mammalian (pEGFP, pcDNA3.1mycHis) or yeast (pG-BKT7, pACT2) vectors, for example. These plasmids use the CMV and ADH1 promoters, respectively. Transfection of magA constructs was done into the rat pancreatic islet cell line INS-1, the mouse neuroblastoma cell line N2A, and canine bone marrow stromal cells. Compared to SPIO (super paramagnetic iron oxide) transfected INS-1 or N2A cells, in which the iron particles are compartmentalized by a dextran-coated shell, magA transfected cells show similar compartmentalization, using membrane-bound vesicles instead of the dextran shell (FIG. 2). These data demonstrate that endogenous cellular contrast can be achieved in mammalian cells through the expression of a magnetosome gene that forms a magnetosome-like structure as a contrast agent.

Characterization of magA expression from pEGFP was confirmed by fluorescence microscopy (FIG. 2A) and Western blot using antibody to GFP. As well, electron microscopy was used to visualize electron dense vesicles. Magnetosome-like structures were identified as dense core vesicles distinct from the morphology of secretory granules in endocrine cells (FIGS. 2C, D). The electron dense core of these vesicles is consistent with an increase in iron content in MagA transfected cells, as identified by Prussian blue stain (FIG. 2B).

Magnetosome vesicles may contain biomineralized iron, or may be empty, depending on whether or not cells are grown in an iron-rich or iron-depleted environment (Komeili et al., 2006). The effect of recombinant magnetosome nucleic acid expression in eukaryotic cells resulting in recombinant magnetosome structures that enclose iron-containing particles can be seen over a broad range of iron concentrations, including for example and without limitation, concentrations ranging from at least about 0.1 micromolar and higher. For example, MagA expressing cells cultured in media having from about 0.25 micromolar to about 250 micromolar iron can produce magnetosome-like structures enclosing suitable amounts of iron. In other examples, the iron concentration may range from about 0.40 micromolar to about 200 micromolar. Typically, any physiological eukaryotic environment provides sufficient iron for recombinant magnetosome nucleic acid expression to result in a magnetosome-like structure enclosing useful levels of iron. Furthermore, non-toxic iron concentrations that are higher than physiological iron concentrations may be used. Simply as a further illustrative concentration range, and without limitation, useful iron concentrations may range from about 0.1 micromolar to about 500 micromolar. Even higher concentrations may be used, if desired.

Imaging or analysis of magnetosome-like structures may be performed using a variety of techniques for example electron microscopy, MRI, X-ray imaging, and the like. Magnetic resonance imaging (MRI) requires cellular or tissue contrast to distinguish given morphology or anatomy. Superparamagnetic iron is an ideal contrast agent. Magnetite crystals synthesized within bacterial magnetosomes provide permanent, single-magnetic-domain particles, suitable for MRI. As has been shown in the present disclosure, recombinant magnetosome-like structures produced in eukaryotic cells provide permanent, single-magnetic-domain particles, suitable for MRI. Nuclear medicine imaging techniques, that rely on radioisotopes, can be paired with MRI to provide hybrid imaging that combines the sensitivity of radionuclides with the superior resolution of magnetic resonance. One example is, PET (Positron Emission Tomography)/MRI technology. Another example, is a PET/CT (x-ray Computed Tomography) hybrid imaging systems. Furthermore, eukaryotic cells comprising magnetosome-like structures may be useful for registration of MRI with CT. Both MRI and CT can provide anatomical information even though the methods rely on different premises.

Aspects of the invention have particular use with eukaryotic cells that express or over express one or more magnetosome proteins as magnetosome-like structure contrast agents permitting in vivo or non-invasive MRI or x-ray imaging studies to follow the localization, proliferation, and long-term tracking of cells comprising magnetosome-like structures. These cells may be tissue specific and permit non-invasive in vivo imaging of specific physiological functions. Since the magnetosome-like structures are localized and susceptible to directed energies, other potential uses include, but are not limited to, creation of directed hyperthermia (Hergt et al., 2005), for example MR guided ultrasound to generate thermal ablation, magnetic ablation treatment through increased power absorption rates with electric or magnetic transmitters (Hilger et al., 2002), magnetomechanical stimulation (Lin et al., 1999), magnetically guided transport of drugs (Schuler and Frankel, 1999) or bacterial detoxification of environmental contamination (bioremediation).

Aspects of the present invention have further wide potential clinical uses such as described below.

Cardiac Stem Cell Transplantation

After a heart attack, the patient is often left with a large amount of scar tissue in place of normally contracting heart muscle. If the amount of tissue is large enough, the patient's physical activity is limited and they may go on to chronic heart failure and death. Heart transplantation remains the treatment of choice, but the number of available organs will never meet more than a small fraction of the growing demand. As another treatment option, stem cell therapy to regenerate the damaged heart is being aggressively pursued. What is needed is a way to image, quantify and monitor the progression of transplanted stem cells from undifferentiated to differentiated states, as the cells repopulate the scar tissue with normally functioning heart tissue. The use of magnetosome-like structures to track the progress of tissue regeneration has both research and therapeutic applications.

a) Prior to transplantation, stem cells would be transfected with magnetosome-producing genes to follow the fate of the transplanted cells by MR imaging. This type of experiment would follow the original stem cell population, from transplantation to lineage commitment and differentiation, by the production of magnetosome-like structures.

b) To monitor the switch from proliferation to differentiation, cells would be transfected with magnetosome constructs in which the promoter responds to stage-specific differentiation signals. This type of experiment would indicate early and late events in stem cell differentiation and localize these events within the injured heart.

c) Different types of cellular differentiation would be monitored by transfecting stem cells with magnetosome constructs that respond to transcription factors present in specific types of cardiac cells, such as smooth muscle cells, endothelial cells or myocytes. This type of experiment would indicate the number of stem cells needed for successful treatment and how efficient stem cells are at producing functional myocardium.

d) The rate of stem cell loss after transplantation would also be monitored by placing magnetosome genes behind promoters sensitive to apoptotic signals or co-expressing magnetosomes with early markers of apoptosis. In this context, magnetosome-like structure formation would localize the extent of programmed cell death that undermines stem cell therapy in a given organ.

e) In cardiac cells, the protective effects of heat shock proteins (Lin et al., 1999) constitute a natural defense against ischemia through preconditioning. This protective mechanism will be monitored in vivo by placing magnetosome gene(s) under the control of an inducible heat shock promoter to understand the timing and location of this survival mechanism.

f) The regulation of magnetosome-like structure production would be genetically controlled by the expression of inhibitory factors that prevent magnetosome proteins from assembling or functioning. These negative regulators would be under selective promoter control, responding to exogenously administered antibiotic or pheromone, or targeted directly to the magnetosome by virtue of its magnetic properties.

Monitoring Gene Therapy in Diabetes

In diabetic disorders, the pancreas fails to produce sufficient insulin for the natural absorption of glucose. Regeneration therapy of pancreatic β-islet cells, which produce insulin, may provide a cure for diabetes (Yamaoka, 2002). Various therapeutic strategies, including islet transplantation, cell-based therapy, gene therapy and drug therapy to promote β-cell formation and proliferation have been suggested. Magnetosome expression in transplanted islets or the cells used for gene or cell-based therapy would provide an endogenous monitoring system for these treatments.

a) Co-transfection of islet or stem cells with the insulin promoter driving MagA expression, to turn on magnetosome production once the transplanted cells start producing insulin, will allow functional monitoring of the regeneration therapy. This system would be valuable for in vivo as well as in vitro analyses.

b) Evidence of glucose-stimulated insulin secretion, characteristic of pancreatic beta cells, will be obtained from magnetosome-protein expressing cells in an insulin target tissue. In response to a rise in serum insulin, cells within the target tissue that express magnetosome genes off an insulin-sensitive promoter will be labelled with magnetite crystals and suitable for MR imaging. This type of system will also respond to external stimuli, such as a glucose challenge, that precipitates the secretion of insulin.

c) Transfection of stem cells or islet cells, destined for transplantation into the pancreas of diabetic animals, will be non-invasively monitored by the production of magnetosome-like structures. MR imaging will localize the cells within the target tissue, as well as any ectopic transplantation.

d) Other mammalian cells harbouring both a therapeutic gene and magnetosome gene(s) can be non-invasively monitored by MR imaging. Gene therapy will be administered by an unrelated cell that is targeted to the tissue of interest by a receptor-ligand interaction, such as binding of insulin growth factor receptor to the insulin growth factor. Thus, proteins at the plasma membranes of both cells provide a docking site, permitting localization of the gene therapy and non-invasive tracking of these magnetosome-protein expressing carrier cells.

Cancer Progression and Treatment

Evaluation of tumour progression or regression during cancer treatment is critical to determining the efficacy of the therapy and whether other treatments should be pursued. The effect of cancer therapy on the tumour will be monitored by MR imaging of immune or other cells, targeted to the tumour and transfected with magnetosome gene(s). This provides non-invasive, in vivo monitoring of the cancer.

a) Lymphocytes from the patient will be isolated and transfected with magnetosome gene(s) as well as those for tumour-specific receptors. Upon introduction of these modified cells back into the patient, MR imaging will be used to non-invasively monitor the location of magnetosome-protein expressing cells in the patient. The efficiency of tumour infiltration by the magnetosome-protein expressing cells will indicate the degree of tumour-specific recognition. Magnetosome-like structure production will provide the in vivo assay for the most appropriate tumour-specific, cell surface proteins. This assay can also be used to monitor changes in tumour-specific protein expression, as may, be related to benign versus malignant and dormant versus metastatic tumours.

b) Magnetosome-like structure expressing cells that target the tumour will be used to monitor tumour size over the course of cancer treatment. This will permit vigilant monitoring of tumour growth and aid in the timing and selection of treatment regimens.

c) Magnetosome-like structure expressing cells that target the tumour will be used to monitor metastases. The spread of cancer will be identified and localized by MR imaging of magnetosome-like structures co-expressed in cells with genes that are characteristic markers of metastasis. Non-invasive imaging of metastases will aid in directing treatment to the correct location. The production of magnetosome-like structures will also assist in distinguishing which population of tumour cells become metastatic and which remain dormant.

d) Cells that produce magnetosome-like structures that target the tumour will be used to direct magnetic field effects, such as hyperthermia, or delivery of other treatments to the tumour.

e) Cells that produce magnetosome-like structures that target the tumour will be used to colocalize tumour antigens, or other tumour-associated proteins, that cause differentiation or apoptosis of magnetosome-expressing cells, in response to tumour progression or arrest. These changes in magnetosome-expressing cells may reflect the presence or absence of growth factors, or other signal transduction activity, in the neighbouring tumour cells.

f) Since magnetosome-like structure formation/expression is recapitulated with each cell division, cells from tumour biopsies can be cultured in vitro, transfected with magnetosome gene(s), and studied over the long-term in laboratory animal models. In this way, MR imaging of magnetosome-expressing cells can be used to develop novel treatments for specific types of cancer.

g) Magnetosome-expressing cells that target the tumour can be cultured and implanted under iron-deficient conditions, such that tumour angiogenesis will be monitored by the increase in MR signal paralleling increases in capillary bed formation.

h) It is proposed to (1) follow molecular events in metastasizing cells using a novel reporter gene recently developed in our laboratory (Goldhawk, McCreary et al. 2006; Prato, Goldhawk et al. 2006), (2) develop quantitative tracking methods by co-labeling cells in vitro with a radioisotopic imaging agent which can report the number of transplanted cells remaining viable (Jin, Kong et al. 2006; Stodilka, Blackwood et al. 2006; Stodilka, Blackwood et al. 2006), and (3) demonstrate this methodology in a well-established mouse brain metastasis model (Heyn, Ronald et al. 2006).

To develop MagA as a reporter gene for MRI and cancer therapy, constitutive MagA expression will be compared with that of a MagA reporter construct, driven by activation of a relevant oncogenic promoter. Transfected cells may be monitored in vitro by MRI (Goldhawk, McCreary et al. 2006) and SPECT (single photon emission computed tomography; Tai, Nguyen et al. 2006), and analyzed for magnetosome-like structures by electron microscopy, energy dispersive x-ray, and immunofluorescence microscopy.

The efficacy of MagA labelling in mouse will be compared to that of $^{111}$Indium-tropolone, which has been used extensively in a canine, cardiac stem cell transplantation model (Blackwood, Kong et al. 2006; Jin, Kong et al. 2006). Hence, both large and small animal imaging are feasible, with the registration of CT (x-ray computed tomography) and MRI images providing the necessary anatomical link between the SPECT radiotracer signal and MagA signal voids generated by MRI. Estimates of cell number may also be correlated to histological analysis of tissue ex vivo, at designated time points.

Thus MagA may be used as a contrast agent for molecular imaging with MRI, with the design of a MagA reporter probe, and demonstrate its application in a cancer cell model. Non-invasive imaging of a cellular probe which is subject to gene regulation may provide information about cell localization, migration, viability, proliferation and state of differentiation. This will have a broad application in tracking cells of all types, from metastasis of breast tumours (Chambers, Groom et al. 2002), to function of pancreatic islet cells (Goldhawk, McCreary et al. 2006) in diabetes and fate of bone marrow stem cells (Jin, Kong et al. 2005) being developed for cardiac cell therapy. Once the fate of transplanted cells is understood, further therapies may be developed to optimize treatment of human disease.

Developmental Biology

Magnetosome-protein expression in mammalian or other germ cells leading to magnetosome-like structure formation will be used to monitor development of the fetus, including transgenic animal development, in which specific genes are either overexpressed or knocked out. This research will contribute to our understanding of both normal and aberrant development by providing a method for non-invasive, in vivo imaging of the cellular changes that accompany growth and differentiation of an organism. Magnetosome expression during development will be used to identify the location and temporal manifestation of birth defects by MR imaging so that preventative measures can be developed and implemented.

a) Oocytes will be transfected with magnetosome gene(s), fertilized and implanted into pseudopregnant females. Fetal development will be monitored by MR imaging of magnetosome-like structures as the zygote evolves into pre-implantation embryo, and transitions through implantation and organogenesis. This non-invasive method of monitoring development will be applicable to both vertebrate and invertebrate animals.

b) Select aspects of development will be examined by placing magnetosome gene(s) behind organ-specific promoters, such as the nestin promoter used for tracking neural development. In this way the onset of specific tissue formation can be identified and correlated with other gene expression and nascent morphology of the organism.

c) Transgenic constructs bearing magnetosome gene(s) will be inserted into the host genome so as to (1) create a nondisruptive addition to the genome, (2) replace nonessential genes, or (3) knock-out specific target genes. Specific genetic constructs can be engineered to control the embryonic expression of magnetosomes by diet, molecular agonist or antagonist. Selective expression of magnetosome-like structures during development will be used to mark the onset of particular developmental events, and may be linked to other gene expression, such as pancreatic insulin or lung surfactant production.

Plant Research

The development of hardier crops, able to withstand environmental extremes has been facilitated by research aimed at creating transgenic plants. Magnetosome-like structure formation in plants will be used both in research and industry to improve, and add versatility to, crop production.

a) To assist plant growth in space, magnetosome-like structure formation will impart magnetic properties to plants, allowing them to grow in the proper orientation in the absence of gravity, that is toward a magnet.

b) Creation of a magnetosome-like structure forming line of grape vines will assist in the development of roots that can survive during the winter frosts found in colder climates. Transgenic plants that respond to magnetothermal exposure will make northern climates more arable and therefore habitable. This technology will be adapted to other essential crops, providing a safeguard from unseasonal frost and potentially introducing winter crops to regions that traditionally experience a shorter growing season.

Functional Molecular Imaging

Many features of cellular function are defined by the nature of the cell's protein-protein interactions. The expression of magnetosome gene(s), to provide magnetosome-like structures as contrast agents to enhance cell contrast for MR imaging, provides an assay for cell specific activity. Combining magnetosome gene expression with protein-protein interactions will expand the development of functional molecular imaging.

a) The yeast two-hybrid screen employs multiple reporter genes, each responding to particular regions of the GAL upstream activating sequence that regulates galactose in yeast. The modular nature of the GAL4 transcription factor DNA binding domain and activation domain has been adapted for the detection of protein binding interactions. Activation of gene transcription is determined by protein-protein interaction, where the binding partners are fused to either the GAL4 binding domain or activation domain. Magnetosome gene expression will be linked to activation of the GAL promoter, such that a given protein-protein interaction can be identified by MR imaging.

b) Whereas fluorescence activated cell sorting (FACS) is used to separate transfected cells based on the expression of a fluorescent tag, magnetosome gene expression will be used to separate transfected cells based on their acquired magnetic properties.

c) Magnetosome gene expression in nonmagnetic bacteria will couple magnetic properties to other bacterial functions, whether for genetic engineering or bioremediation. Molecular cloning of therapeutically valuable proteins, such as recombinant insulin used to treat type I diabetes, or recombinant viral proteins used for vaccines, in magnetosome expressing host cells or from magnetosome expression vectors, will provide another method for selecting clones of interest based on magnetic resonance imaging.

d) The gene(s) that contribute to formation of magnetosome vesicles are distinct from the gene(s) that induce magnetosomes to cluster along the plasma membrane. The MR signal monitors the subcellular organization of magnetosomes by the change in signal intensity.

Carbon Fixation by Diatoms

Carbon fixation by phytoplankton is believed to correspond to half the earth's total carbon fixation, with half of that exported to the deep ocean as sinking particles. This apparently regulates atmospheric $CO_2$ and hence climate. However, at present diatom fixation of carbon is considerably less than that in the past, particularly during former ice ages. This is believed to be related to a low concentration of iron available to diatoms in some 30% of the oceans. It has been suggested that iron "fertilization" of the oceans could increase carbon fixation by diatoms and hence counter global warming. However, before embarking on such an endeavour more needs to be understood regarding copper biochemistry and how it affects iron biochemistry. Iron-limited diatoms have a higher affinity or demand for copper, and vice versa. Hence, before supplementing iron-limited diatoms, knowledge of the iron-copper relationship is required. Magnetosome-like structure formation in diatoms would assist in directing diatoms to parts of the oceans in which they are low in concentration and $CO_2$ fixation is diminished.

When introducing elements disclosed herein, the articles "a", "an", "the", and "said" are intended to mean that there are one or more of the elements unless the context dictates otherwise. For example, the term "a compound" and "at least one compound" may include a plurality of compounds, including mixtures thereof. The terms "comprising", "having", "including" are intended to be open-ended and mean that there may be additional elements other than the listed elements.

The above disclosure generally describes preferred embodiments of the present invention. A more complete understanding can be obtained by reference to the following specific Examples. These Examples are described solely for purposes of illustration and are not intended to limit the scope of the invention. Changes in form and substitution of equivalents are contemplated as circumstances may suggest or render expedient. Although specific terms have been employed herein, such terms are intended in a descriptive sense and not for purposes of limitation.

EXAMPLES

Example 1

MagA cDNA was obtained from magnetotactic bacteria by RT PCR and cloned into pCR2.1-TOPO. The insert was sequenced, subcloned into pEGFP and pcDNA3.1mycHis, and transfected into INS-1, N2A and bone marrow stromal cells using Lipofectamine 2000, according to the manufacturer's protocol. Prior to harvesting, transfected cells were cultured in media supplemented with 250 μM ferric nitrate, then mounted in Nunc 96-well ELISA wells, embedded between 4% and 1% gelatin, and overlaid with 2% gelatin. FIG. 2A shows the expression of EGFP-MagA fusion protein in INS-1 and N2A cells. FIGS. 2C and 2D shows the dense core vesicles formed in INS-1 cells, subsequent to MagA overexpression. FIG. 2E shows the results of MRI of MagA expressing INS-1 cells. Areas of signal loss represent the formation of magnetosome-like structures in transfected cells.

Example 2

MagA was expressed as a fusion protein from pEGFP-C3. Lipofectamine transfection was done of INS-1 rat islet cells and N2A mouse neuroblastoma cells. Protein expression was examined by epifluorescence microscopy. Magnetite formation was monitored by Prussian Blue stain for iron. Ultrastructural analysis was done using Transmission Electron Microscopy (TEM). Non-invasive imaging of cells was done with Magnetic Resonance Imaging (FIGS. 3-5).

Neuroendocrine and bone marrow stromal cells were transfected with an EGFP-MagA construct and examined for evidence of MagA expression, iron retention and magnetosome formation. Fluorescence microscopy showed cytoplasmic GFP fluorescence, indicating that MagA was expressed in each cell type examined. Cells expressing MagA were incubated overnight in media containing 250 μM ferric nitrate, and the extent of Prussian Blue staining indicated that MagA expression was correlated with iron retention. Electron microscopy showed the formation of electron dense, cytoplasmic vesicles in cells overexpressing MagA under iron-rich conditions. Similarly transfected cells were examined by MRI using a simple Gradient Echo with a TE of 20 ms and showed some areas of signal loss.

Taken together, these results indicate that MagA plays a role in facilitating the production of an iron-rich, membrane-bound compartment. Hence, engineering cells to manufacture iron-containing vesicles shall enable detection of molecular function with MRI providing a novel approach in multiple cell types in vitro and in vivo.

Example 3

MagA was cloned from *Magnetospirillum* sp. AMB-1 by standard techniques, and expressed as a fusion protein from pEGFP-C3. Constitutively expressed EGFP-MagA was obtained by subcloning into the Enhanced Green Fluorescent Protein plasmid, and transfecting mammalian cell lines using Lipofectamine 2000. MagA expression studies were conducted in the rat beta cell line (INS-1) and in the mouse neuroblastoma cell line (N2A). MagA expression in INS-1 is transient: cells are analyzed within 24-48 hours of transfection. Gene expression off the plasmid may be short-lived. In contrast, data collected from the mouse neuroblastoma cell line, N2A is based on stable transfection of magA in N2A: cells are subjected to 2 or more weeks of antibiotic selection before further analysis. More specifically, mouse neuroblastoma (N2A) cells were transfected using Lipofectamine 2000 and selected with Geneticin. Gene expression has usually been incorporated into the cellular genome for long-term expression.

Both transient and stably expressing cell populations were examined for green fluorescence on an Olympus IX81 inverted microscope. MagA expression was correlated with iron retention using DAB-enhanced Prussian Blue staining. Ultrastructural analysis of transfected cells was conducted using transmission electron microscopy. Non-invasive imaging of viable cells was performed by MRI on cells using an 11T (11 Tesla magnet) Bruker and simple gradient echo with a TE of 20 ms.

Fluorescence microscopy showed cytoplasmic GFP fluorescence, indicating that MagA fusion protein is expressed in each cell type examined. In cultures supplemented with ferric nitrate, the extent of Prussian Blue staining indicated that MagA expression is correlated with, iron retention. Ultrastructural analysis of transfected cells showed the formation of electron dense, cytoplasmic vesicles in cells overexpressing MagA and cultured under iron-rich conditions. High field MRI, performed on cells mounted in gelatin, showed some areas of signal loss (FIG. 6) using a simple gradient echo with a TE of 20 ms.

Example 4

N2A cells were transfected with full-length MagA (pEGFP-C3/MagA(R1) stop85W) using Lipofectamine 2000 and grown under neomycin selection. MRI was performed on cells mounted in gelatin, after culturing in the presence or absence of an iron supplement (250 μM ferric nitrate). Culture media, in the absence of an iron supplement, contains 0.25 μM ferric nitrate. Signal voids, represented by blackened areas on positive contrast images or conversely by white regions on negative contrast images, indicate the degree to which MagA expressing cells may be detected. A, E, $10^6$ cells without iron supplement (0.25 μM ferric nitrate); B, F, $10^6$ cells with iron supplement; C, G, $10^5$ cells with iron supplement; D, H, $10^4$ cells with iron supplement. Samples E and H contain strands of human hair to mark the plane of focus. Each data set (A-H) contains images captured in adjacent, axial cross-sections.

Example 5

Neuroblastoma N2A cells were transfected with either pEGFP-C3 alone or containing MagA V137E (Valine replaced with Glutamate at position 137) inserted at Eco R1. Transfected cells were selected over 2 to 3 weeks with Geneticin and cultured in media containing an iron supplement (250 μM ferric nitrate). Approximately $10^6$ cells were mounted in a gelatin mold and imaged at high field strength (11 Tesla) by MRI. FIG. 8A shows MR imaging of a gelatin mold alone in the absence of cells, in positive and negative contrast images, at 2 different focal planes. The gelatine mold background is seen to be minimal. FIG. 8B shows the background provided by 1 million cells cultured with an iron supplement expressing vector alone without MagA, in positive and negative contrast images, at 2 different focal planes. FIGS. 8C, 8D, and 8E pertain to cells comprising a vector with MagA insert and having been cultured in iron supplemented media. FIGS. 8C and 8D each show numerous signal voids, from cells comprising vector with MagA V137E insert, for 4 different focal planes in positive contrast (FIG. 8C) and negative contrast (FIG. 8D) images, while FIG. 8E shows spin echo imaging at these 4 focal planes. Spin echo imaging sequences at each focal plane indicate that signal voids cannot be attributed to air pockets. Human hair marks the focal plane.

The results herein suggest that expression of magnetosome nucleic acids and production of magnetosome proteins in mammalian cells is associated with (a) iron retention and the formation of dense core vesicles, and (b) magnetic properties useful as a contrast agent. These data identify the potential use of magnetosome nucleic acids as a reporter gene probe that will function as an MRI contrast agent. Magnetosome gene expression systems for MRI are useful for non-invasive detection of molecular events in cells, tissues and animals.

REFERENCES

Arbab, A., Bashaw, L., Bradley, R., Jordan, E., Bulte, J., and Frank, J. (2003). Intracytoplasmic tagging of cells with ferumoxides and transfection agent for cellular magnetic resonance imaging after cell transplantation: methods and techniques. Transplantation 76, 1123-1130.

Bauerlein, E., Schuler, D., Reszka, R., and Pauser, S. (2001). Specific magnetosome, method for the production and use thereof, U. P. Office, ed. (United States: Max-Delbruck-Centrum fur Molekulare Medizin and Max-Planck-Gesellschaft zur Forderung der Wissenschaften E.V.).

Bauerlein, E., Schuler, D., Reszka, R., and Pauser, S. (2002). Magnetosomes, method for making and using, U. P. Office, ed. (United States).

Bazylinski, D., and Frankel, R. (2004). Magnetosome formation in prokaryotes. Nat Rev Microbiol 2, 217-230.

Bulte, J., Douglas, T., Mann, S., Frankel, R., Moskowits, B., Brooks, R., Baumgartner, C., Vymazal, J., and Frank, J. (1994). Magnetoferritin. Biomineralization as a novel molecular approach in the design of iron-oxide-based magnetic resonance contrast agents. Invest Radiol 29 Suppl. 2, S214-S216.

Chalfie, M., Tu, Y., Euskirchen, G., Ward, W., and Prasher, D. (1994). Green fluorescent protein as a marker for gene expression. Science 263, 802-805.

Dhanvantari, S., Foster, P., White, D., McCreary, C., Nguyen, B., Mugimba, A., Chan, K., Hoffman, L., McGirr, R., Kovacs, M., and Wells, R. (2006). Cellular and molecular imaging of pancreatic islet cells, In Keystone Symposium, Towards Understanding Islet Biology.

Dhanvantari, S., Tai, J.-H., White, D., Heyn, C., Rutt, B., and Foster, P. (2004). Single cell magnetic resonance imaging of beta cells, In Annual Meeting of the Canadian Diabetes Association.

Genove, G., DeMarco, U., Xu, H., Goins, W., and Ahrens, E. (2005). A new transgene reporter for in vivo magnetic resonance imaging. Nat Med 11, 450-454.

Grünberg, K., Wawer, C., Tebo, B., and Schüler, D. (2001). A large gene cluster encoding several magnetosome proteins is conserved in different species of magnetotactic bacteria. Appl Env Microbiol 67, 4573-4582.

Hautot, D., Pankhurst, Q., Khan, N., and Dobson, J. (2003). Preliminary evaluation of nanoscale biogenic magnetite in Alzheimer's disease brain tissue. Proc R Soc Lond B (Suppl) 270, S62-S64.

Herborn, C., Papanikolaou, N., Reszka, R., Grunberg, K., Schüller, D., and Debatin, J. (2003). Magnetosomes as biological model for iron binding: relaxivity determination with MRI. Rofo: Fortschritte auf dem Gebiete der Rontgenstrahlen und der Nuklearmedizin 175, 830-834.

Hergt, R., Hiergeist, R., Zeisberger, M., Schüler, D., Heyen, U., Hilger, I., and Kaiser, W. (2005). Magnetic properties of bacterial magnetosomes as potential diagnostic and therapeutic tools. J Magn Magn Mater 293, 80-86.

Hilger, I., Fruhauf, K., Andra, W., Hiergeist, R., Hergt, R., and Kaiser, W. (2002). Heating potential of iron oxides for therapeutic purposes in interventional radiology. Acad Radiol 9, 198-202.

Kirschvink, J. (1989). Magnetite biomineralization and geomagnetic sensitivity in higher animals: an update and recommendations for future study. Bioelectromagnetics 10, 239-259.

Kirschvink, J., Kobayashi-Kirschvink, A., and Woodford, B. (1992). Magnetite biomineralization in the human brain. Proc Nat Acad Sci USA 89, 7683-7687.

Kirschvink, J., Walker, M., and Diebel, C. (2001). Magnetite-based magnetoreception. Curr Opin Neurobiol 11, 462-467.

Komeili, A., Li, Z., Newman, D., and Jensen, G. (2006). Magnetosomes are cell membrane invaginations organized by the actin-like protein MamK. Science 311, 242-245.

Lin, H., Blank, M., and Goodman, R. (1999). A magnetic field-responsive domain in the human HSP70 promoter. J Cell Biochem 75, 170-176.

Matsunaga, T. (2000). Protein-bound magnetic particles and process of producing the same, U.S. P. Office, ed. (United States: TDK Corporation).

Matsunaga, T., Nakamura, C., Burgess, 3., and Sode, K. (1992). Gene transfer in magnetic bacteria: transposon mutagenesis and cloning of genomic DNA fragments required for magnetosome synthesis. 3 Bacteriol 174, 2748-2753.

Matsunaga, T., Takeyama, H., and Okamura, Y. (2004). Magnetic particle membrane-specific protein, U.S. P. Office, ed. (United States).

Okamura, Y., Takeyama, H., and Matsunaga, T. (2001) A magnetosome-specific GTPase from the magnetic bacterium *Magnetospirillum magneticum* AMB-1. J. Biol. Chem. 276, 48183-48188.

Ritz, T., Thalau, P., Phillips, 3., Wiltschko, R., and Wiltschko, W. (2004). Resonance effects indicate a radical-pair mechanism for avian magnetic compass. Nature 429, 177-180.

Schüller, D. (April 2004-March 2006a). Main themes of scientific work, In Biannual Report, Department of Microbiology (Max Planck Institute for Marine Biology), pp. 79-80.

Schüler, D. (April 2004-March 2006b). Survey of major projects, In Biannual Report, Research Concept (Max Planck Institute for Marine Biology), pp. 13-14.

Schüler, D. (2004) Molecular analysis of a subcellular compartment: the magnetosome membrane in *Magnetospirillum gryphiswaldense*. Arch. Microbiol. 181, 1-7.

Schüler, D., and Frankel, R. (1999). Bacterial magnetosomes: microbiology, biomineralization and biotechnological applications. Appl Microbiol Biotechnol 52, 464-473.

Southward, C., and Surette, M. (2002). The dynamic microbe: green fluorescent protein brings bacteria to light. Mol Microbiol 45, 1191-1196.

Stephens, C. (2006) Bacterial cell biology: managing magnetosomes. Curr. Biol. 16, R363-R365.

Van Roessel, P., and Brand, A. (2002). Imaging into the future: visualizing gene expression and protein interactions with fluorescent proteins. Nat Cell Biol 4, E15-E20.

Walker, M., Quinn, T., Kirschvink, J., and Groot, C. (1988). Production of single-domain magnetite throughout life by sockeye salmon, Oncorhynchus nerka. J Exp Biol 140, 51-63.

Yamaoka, T. (2002). Regeneration therapy of pancreatic beta cells: towards a cure for diabetes? Biochem Biophys Res Comm 296, 1039-1043.

Blackwood, K., H. Kong, et al. (2006). In vivo evaluation of thymidine kinase overexpression to track canine bone marrow stromal cells using dual isotope SPECT. *Fifth Annual Meeting of the Society for Molecular Imaging*. Hawaii, Mol. Imaging. 5: 234.

Chambers, A. F., A. C. Groom, et al. (2002). "Dissemination and growth of cancer cells in metastatic sites." *Nat. Rev. Cancer.* 2: 563-572.

Goldhawk, D., C. McCreary, et al. (2006). Magnetic resonance imaging of cells overexpressing MagA, an iron transporter involved in magnetosome formation. *Fifth Annual Meeting of the Society for Molecular Imaging*. Hawaii, Mol. Imaging. 5: 294.

Heyn, C., J. A. Ronald, et al. (2006). "In vivo MRI of cancer cell fate at the single-cell level in a mouse model of breast cancer metastasis to the brain." *Magn. Reson. Med.* 56: 1001-1010.

Jin, Y., H. Kong, et al. (2005). "Determining the minimum number of detectable cardiac-transplanted $^{111}$In-tropolone labelled bone-marrow-derived mesenchymal stem cells by SPECT." *Phys. Med. Biol.* 50: 4445-4455.

Jin, Y., H. Kong, et al. (2006). Cardiac transplanted $^{111}$In-tropolone-labelled autologous mesenchymal stem cells: in vivo radiotracer kinetics. *Fifth Annual Meeting of the Society for Molecular Imaging*. Hawaii, Mol. Imaging. 5: 403.

Komeili, A., Z. Li, et al. (2006). "Magnetosomes are cell membrane invaginations organized by the actin-like protein MamK." *Science* 311: 242-245.

Matsunaga, T., C. Nakamura, et al. (1992). "Gene transfer in magnetic bacteria: transposon mutagenesis and cloning of genomic DNA fragments required for magnetosome synthesis." *J. Bacteriol.* 174: 2748-2753.

Prato, F., D. Goldhawk, et al. (2006). Provisional patent application No. 60/811,784. U.S. P. Office. USA.

Stodilka, R., K. Blackwood, et al. (2006). Large animal hybrid SPECT/CT using a small field-of-view gamma camera: proof of principle for monitoring cardiac transplanted stem cells.

*Fifth Annual Meeting of the Society for Molecular Imaging*. Hawaii, Mol. Imaging. 5: 418.

Stodilka, R., K. Blackwood, et al. (2006). Performance of hybrid multi-spectral SPECT/CT in tracking transplanted cells in a canine model. *Fifth Annual Meeting of the Society for Molecular Imaging*. Hawaii, Mol. Imaging. 5: 407.

Tai, J. H., Nguyen, et al. (2006) Imaging pancreatic islet cell gene expression using dual-isotope SPECT/CT. *Tenth Annual Meeting of the Canadian Diabetes Association*. Toronto.

Although preferred embodiments of the invention have been described herein in detail, it will be understood by those skilled in the art that variations may be made thereto without departing from the spirit of the invention.

SEQUENCE LISTING (9 sequences)

SEQ ID NO: 1 - DNA, 1324 bp, Magnetospirillum magneticum
taaagtactgtccatggaactgcatcatcccgaactgacctatgccgccatcgtcggcctggccgccgtgctgtgcggcgggatgatgacgcgcctgaagcagccggccgtcgtcggctacatcctggcgggggtggtgctgggacccagcggcttcgggctggtgagcaaccgcgacgccgtggccaccctggccgagttcggcgtgctgatgctgctgttcgtcatcggcatgaagctggacatcatccgctttctcgaagtgtggaagacggccatcttcaccacggttctgcagatcgccggcagcgtgggcacggccctgctgctgcgtcacggcctgggctggagcctggggctggcggtggtgctgggctgtgccgtggcggtgtcgtccaccgccgtagtgatcaaggtgctggaatcctcggacgagctggacacgccggtcggccgcaccacccttggcatcctgatcgcccaggacatggcggtggtgcccatgatgctggtgctggaatccttcgagaccaaggcgctgctgcccgccgacatggcccgggtggtgctgtcggtgctgttcctggtgctgctgttctggtggctgtccaagcgccgcatcgacctgccgatcaccgcccggctttcccgcgattctgaccttgccaccctgtcgaccctggcctggtgtttcggcaccggcgccatctccggcgtgctggacttgtcgccggcctatggggccttcctgggcggcgtggtgctgggcaattccgcccagggcgacatgctgttgaagcgtgcccagccaattggcagcgtgctgctgatggtgttcttcctgtccatcgggctgctgctccccttcaaggttatctggaagaagttggggacctctttcacccgggtgcgcacgcgggagccgttcaaaacgcccctgaacgtcacggccctccccctggcccggcaggattggcccaacgcctccctggccggcgtggccctggcccagatcggcgagttctcgttcctgctggccgagaccggcaaggcggtcaagctgatcagcgcccaggagaccaagctggtggtggcggtcaccgtgctgtccctgggtctgtcgccgttctggctgttcaccatgcggcgcatgcaccgggtggcggcggtgcatgtccattcgttccgcgatctggtcacgcggctgtatggcgacgaggcccgcgctttcgcccgcaacgcgcggcgggcccgtgtgctggtgcggcgtggttcctggagggatgaccccaatgccggacctggctctggaattagtacttag

SEQ ID NO: 2 - DNA, 4967148 bp, Magnetospirillum magneticum (residues 1-1,655,716 of 4,967,148)
  misc_feature (1356851)..(1356852): n is a, c, g, or t
  misc_feature (1380785)..(1380785): n is a, c, g, or t
  misc_feature (2155828)..(2155829): n is a, c, g, or t
  misc_feature (2156370)..(2156371): n is a, c, g, or t
  misc_feature (2157178)..(2157179): n is a, c, g, or t
  misc_feature (2157382)..(2157382): n is a, c, g, or t
  misc_feature (2157945)..(2157946): n is a, c, g, or t
  misc_feature (2158187)..(2158190): n is a, c, g, or t
  misc_feature (2160013)..(2160014): n is a, c, g, or t
  misc_feature (2162065)..(2162066): n is a, c, g, or t
  misc_feature (2162569)..(2162570): n is a, c, g, or t
  misc_feature (2164009)..(2164010): n is a, c, g, or t
  misc_feature (2356104)..(2356104): n is a, c, g, or t
  misc_feature (2473942)..(2473942): n is a, c, g, or t
  misc_feature (4631788)..(4631788): n is a, c, g, or t
tcttcctcccatgtccgagaccatctatgcccttgccagtgccgccggaagggccggaatcgccgtctggcggctgtcgggcgagggcagtgggacagcgctgtccgccctgaccggcaagcccctgcccgagccgcgccgggcccggcgggtccgtttgcgcgacggggcgggggaggtgctggacgacgggctggtcctgtggttccccgcaccccattcctttaccggcgaggatgtggccgaactgcacctgcatggaggacgggcggtcgccgccgccctgacggcgaggctgggcgagctgggcctgcgtccggccgagccgggcgaattctcgcgccgcgccttcctcaacggcaagctggacctgacccgtgccgaggccatcgccgatctggtggatgccgagaccgcggcccagcggcgccaggcgctgcggcaactggacggcggtctggccgggctggtggaaggctggcgctcggccctggtccgtgccatggcccatctggaagcggtgatcgacttcgccgacgaggacattcccgacaccctgctggagcagtcggtgggggaggtgcggtctctgcgccgtgagatggaggtccacctggacgagcggcgcaacggcgaacgcctgcgcgacggcatccacatcaccatcctgggcgcgcccaatgccggcaagtccagtctgctcaaccgtctggccgggcgcgaggcggccatcgtctcggcccaggcgggaaccacgcgggacgtgatcgaggtgcatctcgacctcgggggctggccggtgatcgtcgccgataccgccgggctccgggactcggcgtgcgagatcgagagcgagggggtacgccgggccgcggaccgcgccgccaaggccgatctcaggctgtgtgtgttcgacgggacgctctatccgaatctggacgccgccacgctggaaatgatagacgacgccactctggtggtgctcaacaagcgcgacctgatgaccggggagactccggccagcatcaacggccgcccggtcctgaccctgtcggccaaggcgggcgagggggtcgacgatctggtcgccgaactggccagggtggtggaaagccgcttcgccatggggtcggcgccggtcctcacccgggaacgtcaccgggtggcggtggccgaggcggtggcggcgctcagccggttcgaccccggtctggggatcgagatggcggccgaggacctgcgtctcgccgcccgctccctggggcggatcaccgggcgggtggatgtggaggagattttggacgtcatcttccacgagttctgtatcggcaagtgagcccggcgccggcgcttgaggctaactaaatatggtgtgtttcacgtgaaacaaacaagctcttgcgatgtggtggtgatcggggcgggacatgccgggtgcgaggccgccgccgccgccgcccgattcggtgcccgcacggtgctgctcacccagcgcctggaaaccatcggtgagatgtcgtgcaatccggccatcggcgggctggccaagggtcagctggtgcgcgagatcgacgccatggatgggctgatgggccgggtcatcgaccgggccggcattcagttccgcatcctcaaccgcagcaagggagcggcggtgcagggaccccgtgcccaggccgaccgcaagctttatcgtctggccatgcgggccgcgctggacgagacggaaaacctctccttgctggaaggttcggccgaggatctggtgatcacggacgggcgggttgccggggtggtgttggccgacggttcgaccatcgcctgcggggcggtggtcatcaccaccggcaccttcctgcgcggcttgatccatctgggggagaagacctggccggcgggacgggtgggcgacgcgccgtccctggggctgtccctggcgctggagcgggcggggcttcccctgggccgtctcaagaccggcaccccggcccggctcgatggccgcaccatccattgggactccctggaccgccaggagggcgacgatccgccggtgccgttctcctacctgacggagcggatcaccacgccgcaggtggcctgcggcatcaccgccaccacgcccgagacccacgccatcatccgtgccaacctggaacgggcccccatgtattcgggccagatccagagcaccggcccgcgctattgccccagcatcgaggacaaggtggtgcgctttgccgaccgcgagcggcaccagatcttcctggagcccgaggggctggacgaccacaccgtctatcccaacggcatctccacctcgctgcccgaggacgtgcagctggccatgatcgccaccatccccggcctggagcagtgtcgggtgatccgtcccggctatgccatcgaatatgatttcgtcgatccccgggcgctgcaccgctcgctggagacgaagggagtgggtggtctgttcctggcggggcagatcaatggcaccaccggttatgaggaggcggcgggccagggcctgatggccgggctcaacgcggcgcggcgctgtgccggctcggcaccgctggtgctggaccgcgccgacgcctatctgggcgtgatgatcgacgatctggtcagcctgggaacctccgagccctatcgcatgttcacctcgcgggccgagtaccggctgctgttgcgggccgacaatgccgacagccgcctgacccccaagggacgggaggcgggttgcgtcgactcggagcgctgggccgccttcatggtcaaggccgcggggctggagcggggcagggcgctgctgcaatccctgaagggctcgcccgactggctccgccgccaggggctggagatcaaccgtgacggcgtggtgcggtcggcctgggacctgctggcctatcccgagcttgggcttcaggccctggcggcggtgtggcccgagctggacagcctatccggggcggtggccgagcagctggagatcgaaggccgctatgccggttatctcgaccgtcaggaagccgatatccgcgcctatcgtcgggaggaggggttggccctgtcggccgatctggattacgacgccatcgggtcgctgtccaacgaggtgcggcagaagctcaaggcggcacggcccgagaccctggcggcggcggcgcgcatccccggggtgaccccggcggcggtgacggcgctgctggggcacgtcaagaagatggtgctggactgggccgaggggccggtgccgtgaccacctatattttgtgtttcacgtgaaacacactacagcatggggaatcggattgtgggtccggaagagctgctaaccaaatctggtgtttcacgtgaaacactcgagcgcctgcgcctgtatgccgatctcctggtcaaatggcaggcccgcatcaatctggtgggcccggacaccgtgccggacttatggtcgcggcacatgctggattccgtccagctgttcccgttgatcaaggtgggggcccggcggctggtggatctgggcagcggcgccggctttcccggtctggtgctggcggtaatgggggcgcccgatgtccatctggtggaaagcgattcccgcaaatgcgcctttctgcgcgaggtggcccgggtcaccgaaaccccggtgaccgtgatcaacaagcgcatcgagcaggtggcgcccctgggggccgatgtggtgacggcccgcgccctggcgccgctcgaccgtctgctcggctgggcctttccccatctggccgaagggggcgaatgtctgttcctgaagggtaggggggcggaagacgaattgaccgcaagtgcgaaagaatggaatatcacggcgagccgggtgccttcgctcaccgatcccggcggtcttgtccttcatctgcgtgaggtatcccgtggccgagcccagccgtagcagcgcccgagtcattgccgtcgccaaccagaagggcggggtgggcaagaccaccaccgccatcaatctggcgaccgccatggcggcgaccaagaagacggtgctgatcatcgatctcgacccccagggcaatgccagcaccgggctgggcatcgaccggtcggcgcgtgacgtcaattcctatcatgtgctgatcggcgaggcggccctggccgacgcggtgctgaccacctccattcccggcctgtccctggtgccgtcgggcgtcgacctgtcgggcgccgagatcgagctggtggaattcgaacgccgcgagcatcggctgaaggaatccctggccgggtcgctgggcgcctatgactacgtgctgatcgattgcccgccgtcgctgaacctgctgaccctgaacgccctggtggcggccaatgcggtgatggtgccgctgcaatgcgagttcttcgccctggaaggcgtcagccatctgatcaagaccatcgagcgggtgcgtcaggccttcaatccccagctggaattgcagggcatcattctgaccatgttcgacaagcgcaacaacctgtccgatcaggtggccgccgatgtgcgcgactatttcggcgacaaggtctacaagacggtgattccgcgcaatgtccgggtgtccgaggctcccagccatggcaagccggtgctgctctacgatatgaaatgcacggggtctgaggcctatatcagtctggcctcggaagtgttgaagcgcgagcgggaattgagggcataaaattggctgaagaaaagaagaagggtctggggcgcggcctgtccgccttgctgggcgatcacgcggcctcggccatcgcggcggtgaccagcgcggcggcggcggggccggaaggtcaggcggccatcaagggcctgcgcaccatgccgctggaacatctccagccgggtaagttccagccgcgccggaccttcgacgaggaccgtatcgccgatctggtggaatcggtgcgggaaaagggcatcctgcagccgctgctggtgcgcccgctgccgggcaatcccgcgcgtttcgagatcatcgccggcgagcgtcgctggcgggcggcccagggcgccaagctgcacgaggttccggtcatcgtccgcgagctctcggaccgcgaggccctggaagtggccctggtcgagaacctgcagcgccaggatctgtcgcccctggaagaggccgacggctatcgccgcctgatggacgagttctcccacacccaggaggaactggccaaggcggtgggcaagtcgcgctcgcacgtggccaacatgatccgcctgctggcgctgcccgacccggtgaagggcatgctggaaaagggcgaactgacggcggggcacgcccgcgccctgctgaccgcggccgacccgctgcggctggcccgcgacgtggtgtcgagggcgctcaacgtgcgccagacggaaaagctggtcaacgacgagggcaaggccaagcccaccagtggcggccgtccggccggcggcggcaaggacccggatatcgcggcgctggaacgcgacctgacctcgcaactgggctgcagggtgggcatccgctctctgggcaaggggggcgaactgaccatttcctacggctcgctggagcagctggacgatatcctggcgcggctgtcccgtaatcccgacccgtcggtggaggatctggacgccgtctgagccggccgaatctcccctctatgaaggacccctccgcctttgtacaataacggcgggcggccggaagaaaccgtgcccggaccgggggagagagcaaggatggcgaacacggatgacaatggatcgctcgacgcgcttctggccaatctgccggacaacgtggtcgagtccttcaccgccgaacagcgggcggctctgtggaacgccgccaagcccatcagctggcgcaagcaccccatcaatatccgcatcacctttcccttcttcggcgggcgccatttcgtgaccatcgtcggcggctatgagcgccgctcgctggaccgcatcaaccgcgaccgccacatgcatccgctgcgaaccgccggcaacgtgctgttcatgctgggggtgggcggcgctttctacctcgccgccgtcgtcggcatcttcaccttttccaacctgatcgagttctgaatgaccacctgtccctgcggctccggccagtcctacgattcctgctgcgaacccttcatcacgggcaaggcgctgccgccgaccccggaagccctgatgcggtcgcgctacagcgccttcaccgtggcggccatcgactacctgcacgacaccctggctcccgacgagcgcggcgattttcaccgcgacgagacggagaaatgggccaagtcgtcccaatggctgggcctgaccatccacggcacctccggcgggggagagggggaggacgaaggcaccgtcgacttcaccgcccgcttccgcatggacaacaagaacgaggctcaccgcgagctgtcgtcctttcgccgcgaagggggccgctggtactacgtcgcaggccgtatcggcggcgcgccggtggaacagcgccgcgtggcggtcaaggcgggccgcaacgatccctgcccctgcggctcgggcaagaagttcaagaagtgctgcggcgcctgattgccgctgccacggtgtactgagagagtgtcccacccccgatatccgcatcacggatttcgggggtagtcgggcgaccactcgatatcgcccgcctgggccattccctgcttttcgtcttcccggaacgacgaaaggccgggcttgcggcccggcctgtctcgtaacactctgattttactgatccgattggagcgggcgaagggattcgaaccctcgaccccaaccttggcaaggttgtgctctacccctgagctacgcccgctctgttcggcgtgttcgctgccgtttccagcggcgaggcccggataatacgaaaagatttggccgacgcaagcactttttcgcatgattcttcacaaggctcgccggggtggggtttgggcttgccagcgcggcggcaacggtccatctattgcgggtctaaaccgccaccagacggacggaaacagccatggacctgatcttcaattctggagcccaaggagctgccggagccgcccagaacgttccgggcgacctgatcaaggacaccaccaccgccaccttcgtggccgacgtcatcgagatgtcccagaaggtgccggtgatcgtcgatttctgggccacctggtgcggtccctgcaagaccttggggccggccctggaaaaggtggtgcgcgaggccaggggcgcggtgcgcatggtcaaggtggacgtggacaagaaccaggatttggcggcgcagctgcgcatccagtccgttcccaccgtctacgccttcaagggcggccgcccggtggacgccttcaccggcgcccagccggaaagccagttgaaggccttcgtcaagaagctgatgtccggctccaatgccgggccgaccatcgacgattacatcgccgaggccaagcgggtgctggaggaaggcgacccccagaccgccgcgaccatcttcaatcagattttgcaggaagcccccgacaacgcgtcggccatggccgggctgctgcgctgcctgatcgcggtgggacagacggcgcaggcggaatccatgctgggccgtctggcgcccgagatcgcccgtcaccccgatatcaccgccgtggccaccgccctggaactggcgcgccatgccggcggcgtgggcgaggccgctgagctgcgccgccgtctggcggccgatcccgatgaccatcaggcccgctacgatctggccctggcctattacgccgcgggcgaggtggaaacggcggtggacgagcttctggacctgttcaagcgcgaccgcgcctggaacgacgacgcggcgcgtaagcagctggtcaagattttcgaggtgctgggcttctcccatcccctggccaagtccggccgcgccagactttccaccctgctgttctcgtaaggcgggccatgcaatccgaccgcaagctgcgactggatgatctgccccgcgacctgccggtctttgcggtctcgggcgccattctcctgcccaagggcagcagccccttcatggtgttcgagccgcgctacctggccatggtcgacgattccctggccatgggccgtatgttcgccctggtccagccgcgcgacgacaaggaccgcagcggcacggtcaaggggctctacgataccggctgtctggcccgcatcaccgcgttcggcgagaccggcgacggccgctatctgatcaccgccgccggcatctgccgtttccgtctcacgggcgaggtggagggccgcgccggctatcgccgggtcagggccgattacacccccttcgccgccgatctggacggcagcgattgcggcccggtagaccgccgcggcttgctgtccatcgtgcgggcctatctgggggggcttggcatgtcggccgacattgcccaattggaaaaggccgacgatgccgatctgacggtgcgtctggccatggcctgccccttcgcccccgtggagaagcaggccctgctcgaagccgctagccacgccgagcgctgccggctgatgaccacgttgattcaacgggaactgctgaacgaaaccggcggttcctccattcattaggagcggtttcaatgcccgagcgtgtttcggctttcgataccaagctgctggatatcctggtggcgccaggcacccatgcgccgctgcgctatgacgccggcgcccaggagctgatcgacgacaaggcctgcctcgcctatcccatccgcgacggcattccgatcatgctggtggacgaggcccgctccaccgaaggagacggccaatgaacatgcaagccgaacgcccctggcccgaggagatcaaggtcgacaaggttgcccgcacgctgcgcgttgccttttccgacggcaagaccttcgtgctgcccgccgagctgctgcgggtggaaagcccctcggccgaggtccaggggcactcccccgaccagcgtcaggtggtctcgggccgcatgcatgtgggcatcatcggcgtcgagccggtgggcaattatgccgtcaagctggtgttcgacgatctgcacgacagcggcatctactcctgggactatctctatggcctgggggccaaccaggacgccatctgggccgattacctggccgagatcgaggccctgggcctgtcgcgcgatccggccctgaccaaggcaccggcgcccaaggcccatggctgcggcggtggtggcggggccaagtcgggcggtggctgcggctgcagttgagggcccatgtccaagaccacccgcgccacccaagccctggataaggcaggcattgcctacgaagtgtgcagttatgcctatgacccggatgccgacaaagtaggcatgcaggcggccgaggccttgggcgtcgcccccggcatggtgctgaagaccctgatggtgctggccgacggcaagcccgcctgcgtggtggtgccgtcggaccgcgaggtctccatgaagaagctggccgccgccctggcggccaaatcggcccagatgatgaaacccgccgatgccgagcgtctgaccggctttgtggtgggcggcatttctcccttcggccagaagcgcgccgtccccactttgatggaggagggcgccctgggtcagccccaggtgttcttgaacggcggccagcggggattgcaggtcaagctttccccggctgatgcgctcaaggccctgggggccaaggcggccgccgtggtggcgtagggctacgcccctttggggctttcgccccaaaccccaatcgggaggattcgcccgaaccctcttttgctttgaaaatctggggggcgacccgatctacagcgtcttgccctgcatcaggcggggcagatcgcccaccaggcccatggcgtggcgcatgaagaagcgcttggtgtggcccaactgatgcactccggccagtcccaggcggcggacgtgcttcagcagctccacgtcattggagaacagccggtccagcccgtcggtcaggcccagcatcagcatggtgtcgaagcggcgccagcgctgatagcgctcgagaacgtccggcccgcccggatcgaggccgaggcgcagcgcgtcggcgatcacctcggccagggcggccacgtcgcggatgcccatgttcatgccctggccggcgatgggatgcatgccgtgggcggcgtcgccgatcagcgccagccggtggtcgatcatggcttcagcgaattgcagggtgagggggtggtggaaacgcgcgccctctacctggatctcgcccaggaacccgccgaccttggcggccagctcggcgcggaaggcctcatcatcctgggcgcagatggcggccgccaccccattggattcggtccagacgatgccgctgcggttgcccgccaggggcaggatggcgaagggcccggccggcaggaagcgctcatgggcgatgccgtgatggggcttctcatgggccatgatgcagacgatgccgctctcatggtagtcgcgccgtgtgaccttgatgccggcctgctgccggagagccgagccgcgcccgtcggcggccaccgccagggcggcgtggatcacccgcccgtcctccagctccgcctcgacccggtggggggtccgttcgagccgccccaggcgggccggggccagcaggctgacattgggcgagcgggtcagcgccgccagcaattcccggcggatggccgggttggggacgatccagcccaggggatcgtcgccgatatcctggtggtcgtaatgcaggaacagcggcgagccgccatcggtgacgcggatttccagaatttccccggcctcgtccttcatgccctcccaagccccggaagcggcaatcaccttgcgggcggtataggcgatggcgatggcccgggcgtccgagccgggacggccgagaatttcggggggggcggcttcgaccaccgccacccgaatgccggcccgccccagcacggcggccagcagggcgccgaccggtccgccgccattgatcaggacatcgacgcgcaggagagaagacgtgctcatgactgcagttctgccatcctccgccggtgggcgcaagcgctcggcgtttgagggcttgccatcaacatgcccataagaatcgccgaggaaacaggcaaaaggggtgaaaacgcgctcaagattcgtgcggagcctggaaggggtgtgtttttaatgccttgggaaagcgctgtttttcagtattttcagggtgagggcagatttcggcatgccgcttgaataggaaagggcagcggaacattcgcaagaaggcttgcgaccgatcaaccgtgatccgttctctcggcccgccaggtcatcggcggagtccgcaccgggacgacggatccctggaattgcatggggaccccaagatgaagctgatcatggccatcatcaagcccttcaagctcgacgaggttcgcgaggccctgacgccgctcggcgtccaaggcctgaccgtgagcgaagtcaagggcttcggccgccagaagggacaaaccgaaatctaccgcggtgccgaatacgtggtgaacttcctgcccaaggtgaagatcgaggtcgccgtcaacgacgatctggtcgaccgtgtggtggaggccatccagaccgccgcccgcaccggcaagatcggtgacggcaaggtgttcgttaccgagatccagcaggcctatcgcatccgtaccggcgaaagcaacgcggaagcgctctgacgttttgcctgttggggggaatccggcggacgatcatccgccggggtctcgccacgagcggtgcaagccctcaagcccggaagactcaggtcttccgggcttttgttttgcccgtttccactggggcgccgtcgtaattgaagcatttgccgcacaatattgacctagcacaaaatttgaccatggccccatttccctgcccaaaacttcatcatgggagagaccgtcccagggtcgccggcgacggtcgccggacaaaatcctgtaaatccgcggttttgcggcagttggcacggttcttgttaatggagggacagccgatcgtgccgaggatcatcaacaggccgatcacaacgttcattcgctgagccgcttcgggggtaaccatgaaccatcgtttgaagtccgttctgttaggcgtaggccccgcgctcggccttacgctcctcgcctcgatggcgggtgccgaagaggccgccgcgccggctgctgctgccgctccggtggtgctcgataccgggtcgaccgcctggatgctcacctccaccgccctggtgctgatgatgaccatccccggcctggcgctgttctatgccggcatggttcgcaagaagaacctgctgggcaccatgatgcagagcttcgccatcacctgcgtcgtcaccctgctgtgggtgatcatcggctactccctcgccttcaccggcgagagccccttcatcggcggcatggagcgcttcctgctgaacggcctggagaaggcgtccctggctctgccgaacccggttcccgaatcggtgttcatgatgttccagatgaccttcgccatcatcaccccggccctgatcaccggcgccttcgccgaccgcatgaaattctcctccatgctggtgtttatgagcctgtggctgctggtcgtctacgcgcccatctgccactgggtgtggatgatggacgagaagggcaccgccaccggtttcctgggcaagatgggcgttctggacttcgccggcggtaccgtcgtgcacatcaacgctggtgtcgccggtctggtcgcctgcttgatcctgggcccgcgcaagggctatggcaccgacaacatggctccccataacctgtcgctgtccatcatcggcgccgccctgctgtgggtgggctggttcggcttcaacgccggttccgccgtggccgccgacggccgtgcgggcatggccatggccgtgacccaggtgggtgccgccgccgccgccgtgtcctggatgttcgccgagtggctgctgcgcaagaagccctccgccctgggcatcatctcgggcgccgtggccggtctggtcgccatcacccccgcgtccggcttcgtggacgtcaagggcgccctggtcatcggcctggtggccggcgtggtctgctactggggcgccaccggcctcaagcatgccctgaagtacgacgactcgctggacgccttcggcgtgcacggcatcggcggcatcgtcggcgccatcctgaccggcgtgttcgcggtcgagaagatcggcggcaccgccggtctgctggaaggcaatgccggtcaggtcatgacccaggtctatggcgtgctgaccactctggtctacaccgccgtggtgtcgttcatcctgctcaaggccatcgacatggtcatgggcctgcgggttaccgccgaggaagagcgcgagggtctcgacatcgccctgcacggcgagaccgtccactaaacggaaaaagcctcgccccgtcgccgcgggagagaggtggaggagggcgccggggaaacccggcgctctttttctttatgtgtccctcattcgccgggcagggttctgcgccctccttggctttgtccgctccgcgttcccttcggtccgccgcatcagcggcgcggccccttgggcctagccggccgatggccggcggtcgtgtgtgtccctcggtcgccgggcggggtcaacttccccctggggccggagcggggaatagggtaatactccaatgttcctccaacgtttgccccggcccgatcaaaagacatgatcatcgctcctgctctcgacgcccgccttgacggtctgcccgactatcccttcgcccgtctcgccaagctgctgggggctccggcccggccggattccaccgtcatgtccatcggcgagccccagcaccgcccgcccgccctggtggccgaggtcctggcggccaacacctcgtcctggggcaagtatccgccggccaacggcccggccgaactgcgtcaggccgtggcggattgggccgggcgccgctatgacttgccccaggggttgatcgatccggaaaaggccatcctgccggtggccggcacccgcgaggccttgtatctgattgcccagacggtgtgtggcgaccgggaggggcagcggcccctggtgctgatgcccaacccgttctatcaggtctatgccggcgccgccgtgatggccggggccgagccggtcttcgtgccgggcgccaacggtccggccagccagccagatttctccaccctgcccgccgacctgctggatcgcactgccctggcctatgtgtgcagtcccgccaatccgcaaggctcggtggccgacgccgccctgctggagcggcaggttcggacggcgcgcgatcacgggttcgtcctggcggtggacgagtgctattccgagatctgggacaaggtgccgccgcccggcgtgctgaagacctgcgccgctctgggcgaagggctggccaacgtcctgatgttcaattcgctatcgaaacggtctagcgtgccgggtctgcgctccggcgtggtggtgggcgacgagagggtgattcacgcctttgcccggctgcgctcctatggcggtgccgcgacgccgctgcccatcgccgccgccgccgccgccctgtggcgcgacgaggcccatgtgaccgagagcaacgacctttaccgcgccaagctcgacgtcgccgagcgggttctcggcggccggttcggtttttatcgcccgcccgggggcttctttctgtggctggacgtcggcgacggcgaagccgccgccgtcaagttgtggcaagaaggcaatatccgggttctgcccggcgcctatctcgccgccgaggattccgaggaaggcaatcccggcagccggttcatccgtgtcgccctggtccacgatctggccgggaccgaggcggcattgacccgtctggcctcgatcctgggaggatagcgggaatatggcggctccatcgcgcaagaccatgccctctggcgggttcctgccgcgcgggaccgtggatttcctgcgtcgtcgcctgacccagatgggtgggctgctgctgctggtcctgggcgccgccgggttggccgccttgctgaccgccgatccccacgactccagcttcgacactgccgccagcggcccggtgctgaatgcgcttggccgccccggcgcctggttcgccgacttcctgtttcaggcggtcggctggggtggggccatcctggccatgacctgggtcgtctggggcctgctggtgttgatccgggtgcggctgcccggccgctgggcgctgcgcctgatgatcctgccgccaaccatggtggtgtgggggctggccctggcggcgctgccgctgccggccatgccgtcgctgcccgccggtcccggcggagccctggggctgttgctggtcaaggggcttggtctgctgctgccgcccgaattcgcctggatcgccggtccggccgcctcgctggtcgccctggcggcctcggtgttcgtcttgggcctgaccggtgccgaatgggccgggctgggccgccgttccctcgacatggccagcgccgccggacaggcggcttcggccttgcgcgcccatcccttcgccgatcctgaacccggcatccgtcgcgtcgacccggtgctgcgtcccgtgccggcgcgggccgagccggtggcctcgcccttgccgcccgatgacgaggatgacgacgatcccttcgtgccgcctcccctggatgaaggcgccgagccggcccggccctcgggctccctggtccagcccaagcggccgccggtgacgccgggcaagcgcgagcgtgccgcccgccagggcaccctggacctgggcgctccgccgcctggatcggggtatcaattgccgccgctgaccctgctggccccggcgcccgaccagggtggggcgcgcatcaaccaggacggactggcccagaatgcccgcctgctggaagaggtgctgtccgatttcggcgtcaacggcaaggtggtgaaggtccgccccggcccggtggtgacgctgtacgagctggagccggcgcccggcaccaagaccagccgggtgatcggactggccgacgacatcgcccggtccatgagcgccctttccgtgcgcattgccaccgtgccggggcgcagcgtcatcggcatcgagctgcccaaccagaagcgcgagacggtctatctgcgcgaattgctggccgccgagcagttcgagaaggcctcggccaagctgaccctggtgctgggcaaggatatcggcggcgcgccggtgatggtcgatctcgcccgcatgccccatctgctgatcgccggcaccaccggctcgggcaagtcggtggccatcaacaccatgatcctgtcgctgctctaccgcctgaccccggaagagtgccgcatcatcatgatcgaccccaagatgctggaactgtcggtctatgacggcatcccccatctgctggccccggtggtcaccgaaccgggcaaggcggtggtggcgctgaaatgggcggtgcgcgagatggaagaccgctaccgcgccatgagccagctgggcgtgcgcaacatcgccggctacaaccaccgtctggccgaggcccgcgaccggggcgaagtgctgacccgcacggtgcagaccggttttgatcccgacaccggcaagccgctgtacgaggagcagaccctggcgctggagccgctgcccttcatcgtggtcatcgttgacgagatggccgacctgatgctggtggcgggcaaggacatcgaggcggcggtgcagcgtctggcccagatggcccgcgccgccggtattcacatcctgatggccacccagcgcccgtcggtggacgtcatcaccggtaccatcaaggccaatttccccacccgcatctccttccaggtgaccagcaagatcgacagccgcaccatcctgggcgagcagggcgccgagcagctgctgggccagggcgacatgctctacatggcgtccggcgggcgggtgacccgcgtgcacggccccttcgtctccgacgaggaggtggagaaggtggtggagcatctgcgctcccagggcgagccgtcctatgtggaggcggtgaccgaggaggagcagaccgaatttggccagggcggcggagagggcggcgggtcgggcgacgatctctatgatcaggcggtggccctggtctgccgcgagaacaaggcctctacctccttcgtgcagcggcacttgcagatcggctataaccgggccgcccgcctgatcgagcgcatggaatccgaaggcgtggtgggcaagcccaaccatgtgggcaagcgcgaggttctggcccgtaccggggtcgagtactgaggacgaacaaaattcctccacaatcctggcgccttggtgtcgtggttgttcatcggggtgattggaagacatggtgatgagacggatcgcattctgggcgctgtcggcgctcctcagcctggcggcggtgacggccgaagccgcccaaccggcgcgcacgccgctgaccgcccaggacaaggccgatatcgcccgcgccgaggaatacctcaacggcgtcaccacgctgaaggcccgcttcctccaggtgtcgcccaacggcgcctccgtcgaaggcgacgcctatctgtcgcggccgggcaagctgcggctgcaatacgacccgcccagcccgctgctggtggtagccgatggcagcttcctgatcgtccatgacagccagctgggcgagcccagctatatccccctgggctccaccccggcgggaatcctggtgcggcccggggtcaagctggacggagccgacgtggcggtgacccgggtggtccgcctgcccggcgtggtgcgcatttccgtggtcgaggccgaagaccccgcggcgggcgagatcaccctggtgttctccgacaagcccttcgcccttcggcaatggcaggtcaaggacgcccagcatcaggtgaccaccgtgtccctgtaccagagccaaagcggcctgagccttgattccaagctgttcgagttcaagaatcccaagttcacggctccgactctcaacactggcaactgaggtatgcgttaagcgcatgggcactatgcattatcggtgcctgtgaagggcgaaacgactcaccaaatctcagggagcgcggccgagactgcaatggtccggcccagcggggctggtttcccctgccaccccgccgctccacacggagcaatagggcgcccggttacccccctgaccgggcgcccttttcgtttatatactgtccctcaagcgctgggcgggtttctcgcgaaacccttggttctcgcggcataagccgcggcggcctttggccttgcctcctcgccatagggctcgtcggagttcatcccgtcccgatcaagccggagtctcccgtaattgcgtctcgtcacctggaacatcaactcaatccgcctacgtatcgacctgctgcggcaggtggcgtcggtgatgaatcccgacatcatctgtctgcaggagatcaaggtcgacgacccgttgtttccgctggatgcctgccgcgagatggggttcgggcacgtcgccttccacggcatgaagggctataacggcgtcgccatcctgtcgcgcctgcccatcgccgaggcccggccgctgtcgcgctgcggccgcgatgaccgccgccacctgatggcccggctggagaacggcgtggaggtccattgcctctacattccggccggcggcgacattcccgaccccgagaccaatgacaagttcgcccacaagctggacttcgtgcgcgagatcaccgcctgggcggcggcggaattcaccccggactcccgggcgatcctggccggcgacttcaacatcgcccccctggaagcggatgtctggtcgcacaagcagctgctgaaggtggtcagccacacgccggtcgaggtggagctgctcaatgcctttcaggcttcggttccctttgtggacgccatgcgccacttcgtgccgcccgaggaaaagctgttcacctggtggagctaccgctctcccgactggcaaaagaacgaccggggtcgccgcctcgatcatgtctgggtgacgccggccctggttcccagcctgcgcggcatgctggtcgcgcgcgaggcccgttcgtgggagcagccatccgaccacgtgccggtgatggtggatttcgatctttagcaggctgctgaaaaactccgcttcgcggcagggctaccaccctgacccgtttggaggcacagcctccgaacctccagttctttaaaaagatgcagggttcgggaaactttgcttcccggttgggggatcgggggcgaaagcccccgaagcggagcttttccgcagcctgtcaggggcgactctccagccggtagccgccgccttcgccggccagcactccggcgcccagcttgcgccgcagcttatagatatgggtctccagggtatgggtatcgatgccggcgccatagccccagacctcgtccagcagggtctgacgggggaccacctggccggcggcgcggcatagccggacgaggatggaggattctttggcggtcagtcggaccaacgcccctccatcgccctcgagaatcgagcgaccttcgtcgaagcgccagcgcccgatgtggaatccggcgccattggcggcggcgcgggcgagaatgtcgtcgatgcgggtcattagggcgggcaggcgcagcggcttgggcaccacggcttccacgccgcagcagcggggaatggtggttgggccaagcaacagcatgggcagaatgatgccgtcctgccgcaaccgaagacacaggctggggccgtccaggctctcgtccaccaccgccagatcctgatcgcgtgcccggttcgccgcctcgtccagatccgcggcctcggtcaccgcccagttggcagcggtgcgcaggtggtccgcgacgctccggcgcagcggcgcatcggcgatggcaagaagaatgcggcgagtagagctcatggtctgcctttccgacgttcaccctatatcacacccctttgtgtcctggcgatggcgggggaaggggcgggggcgcggcatggtcagacggaacggcttttcctttttccagcccatgaaaaggctgtatggttccggccggtcgaaaaacgaagcctgtccatgacccgaagcctcgacaccacccccaagccggaaattgcggctccgccctccctggtcgccgttgaccgcgccatcgccgagctgcgccgtggcgggctggtgctggtggagcatgccgatggcgccgcgctgatgatggcggccgaggcggtgtccgacgaaagcctgtctcatctcgcggcggcggccggctccgccaccttgctcggcctcaccggccgccgggccggcgttctgggcctgggcgataccgaggccggggtcttccgggtgacagccgccaacggtttcgatgcggcaacgatcgcgtggctggccgatcccggcgcccgctcgctgcccatgcccgtcttcaaggagctggacgccagacgggccggcggattggacgaggcttgcgtggcgctggccaagctggcccggctgttgccggcggcggtgctggccctggccgcgacccccgcggccgacgtggtacgggtgggggcgaccgagatcaccggctatcaggacaatgcggcacgttcgctgcggcaggtgagtcaggcccgtgtgccgctggagaacgccgagaacgcccgaatcgttgccttccgcccctccgacggcggcatcgagcatctggccatcgtcattggcgaccccgacccggaccagccggtgctggcccggttgcattccgagtgtttcaccggcgacctgctgggttccctgcgctgcgattgcggcgaccagttgcgcggcgccatcgccgagatcgcccagaccggcagcggcgtattgctctatctcgcccaggaagggcgcggcattgggctggtcaacaagctgcgggcctacgaattgcaggatgccgggttcgataccctggacgccaacctgcaactgggcttcgacgacgacgagcggatctatctgccggcggcccagatgttgcggcttctgggcatcagccgggtgcggctgctgaccaacaatccgctcaaggtggatgccctggcccgccacggcatcgaggtcaccgagcgcgtgccgcatgtctttccgtccaatgatcataatcagggctatctgcgtaccaaggcgacccgcagcggccatctgttctgatcggcaggaattgccgtccggtttttgccctgcgacggcttctgccgagcagagggcgacaaaacatcaatgaaaacaatagaatggaagtggcaccgtggttgcaaggatgtgggcgtccttcatccgaggtgcgctatgtcgctttccaccgtgtcttcctaccagcttccgagcctgccgggttcgctggtgccgaccctgcccaccgaaaacgcggtgacggcggcggaagcctcgaaggccgccaatagctcccctgacgtcaagcaactgcccatgttcgccgagggcgacgacgagccctcattctgggacctgctcgatgtgatcaatccgctgcagcacattccgctggtcaacaacgtctaccgcgagctgaccggcgataagatcggcgtagctgcccgtctggtgggtggaaccctcttcggtggcccgctgggtctgatcgcctcggccgccaattgtgtcttggaggaatccactggccgtgacgccggcggtcatgtgctggctctgttccgcgacgacgatgccgccaccggcacgggcacggccctggcctctgcggagaaagcgccggcgcccgaggctcaggccgcccggctggacgcctctccggcccagcagagtcagactctggcgactgccgtaaccaaggcccccgatgccaagctcaccgaatccaggccggatgacgccagcaaggcccagcccctgatcctgtccgatctggtgggcgatgacacgcggcttgccgccaaaccggccgctgccgcgcccctgccggtccagaccgccactgagcaggtcgcggctgccgccaaccggcccatgccgctcggccgtgaatcccggctgatgcccattcccgggcgcaccacgcccctagccacgcaatcgccgccgccgatcggtacgacggtgtccagcaatgcctttcgttccaatgctccggtgaccggtcatcgccccaatgcccagcggacagcgtcggctgccgcggcacagcagatgatggctgctcaggccgaaacatcggccttgcccgcccccggcctaccggccgcccagtcgggcgactggttctcggccaacatgatgcaggccatggacaagtacgagaaaagctcacgtctcggcagcccgtccgccaggaccgttacggagcaataataatcaggtgcgatggccgaaaatggcggagcccacccggacatgggtggcaccctcggccacggcgatctcgaaatccccgctcatgcccatactgaccacaccaagaccgtggcgcttcgccatgtcggccaatagacggaaatggggtgcggggtcctcgtcggctggcgggatgcacatcaggccggccagaggcaggccgaactcgtcgcggcaaagcgccaccatggcatccagttcgccaggtccgatgccggctttttgaggctccagcccggtattgacctggatcaggacccggggccgcctgccgctccgctgcatttcatcggcgatggctcgggccagcttgggccggtccacggtctcgatgacgtcgaacagtgcgacggcgtcgcgaaccttgttggtctgcagcggaccgatcaggtggagttccaggtcgggatattcatctcgcagcccaggaaatttggccttggcctcctgaacccggttttcaccgaacacccgctgaccggcggccatggcctcgcgtatcgcctcggcgggataggttttgctgaccgccaccagggtgacggggcgcccttgcgcggcggcggcgatacgagaccggacggcctctaggcctgtggtgatggcggacaaggcgggggagtctccgttagaatgaggccatgaccctagcaaaccgccgcacccgactcaacacgcccccccacgacccgtttccctggctggtgctggtgaccgacgaggcgcggctgcccgatccccgagcggccatggagcgcctgccaccgggggccggagtcatcctacgccattacggtgccgaaaaaaggcgtcccatggccaaggccgtggccgccctggcgcgacggcgccgtcttgtgctgttggtggccggcgattggcgtctggccgcggaactgggagccgacgggcttcatttgcccgagggcatggcgcgtcacggcttgctggccggagcgctgggctgggtatggcgacggcggcggcttttgctggtggcgtgccatggatccttggccttggggcgcgcccgggatctgggcgctcacggcgcgttactgtcgccggtgtttcccaccgccagccatcccggggcggcaaccatcgggccggtgcgcttcggtctgtgggcgcggcgaacccggattcccgtcatcgcgctgggcggcatgacccgtcagcgcctgcgacatctgcctggggcggcgggaatggcggccatcggatcgctgctggcgtaaaagcgcctcagaaggttggcagcgcctcggcgatggccgccgccaccggacgccagtcgcccactgccggttggcggaacaggcgggccgtcgggtaccacggcgaatcgctccgccggtccagccatcgccattcggggtaggccgatgccatcagccacaaggggcggcccagggctccagccagatgagcggtggaggtatccgacgaaatcaccaagtcgcaggccgtcatcagggcggcagttcccaggaaggccccggcctgatcacagtttccgggcagcggattcagtgggaagggagcctgttccacttgttcgtcgccgccatgcacgctgaagaaatccacccggtccgagagggtggccaggggttccagatgggacagaggtacagaacggaaatgatccagatcataaccggtattgccttgccagttgatggccaccgccagccggccgggatggcgaatacggcggcgccattcttctaccgccgcctcgggggcacggagataggggacgcgaccggctccgaacggctcggtgggccacagcagcaggggtaggctggcgattcccaccttatggtcccagggaggctcggccgtccccatggcgtgatattccagccggggatgagcggtgaaacaaacccgaagcatggcattcattcgggcgggcaatgacaggatgatgcgggcgccccgctccagcagcggcaagacaaagcggatatactggaacgtatcgcccgcgtattgatcctggtcgatcagaatagtgcacccttccaggcgctctggcaggtgagcgacggggcgctggtgacggaattcgtaatcagtccagccggtggcgtaatcctcggcccgcaacgcggcgaatccccggttgaagcgggccagcttgtcgtctggggctaaggccaccgcctggtcgagggcggcacgggcggcggcaacctcgcctttcaggagataggcgttgccccgattgatccaggcgccgacgtggccgggatgggcaacgagaatttggtcgcatagggccagggcctggtcggcgtcgccggccaggtgcaacgccgaggcaagagtggcggcaatgtccggatggccaggcgccaggtcgcgggcttggcgcaattcggccacggcttcgggatagcgacggttggcctgaaggagctgcgccagggtcaggtggaacgatggatcggccggttgggccatgatggcgcgacggatggattcttcggcctcgatccgtccggcgggcttgcccgtcgccagcagggcacgggccagattggcgtgggcggcggggttggaggcgtcgaaggtaatggcacggcggatatggccgattgcctcttcggccagacccaattgcagtctggcgcatccgagcaggtgccaaagacgggcgttgtcggggtgtgcagtcagcagcgcttcggcaatccgggcggcctcggccgggcggccctgctgcatggagatcacggcttgttcgaagctgggcatggtcatatctggctcacaaacagaaagagggcggccgaagccgccctccccatgtcgagatgtcgacgtcctattagaaggacagcgacagaccggtcatggcagtccaaccggagttggagtagtagttgttctggttggcggaagcgccggccagaccatcgcgctggtcgcggtactcgatgtagccaaccgaagccaggacgtcgacgcccggcccgaggttgtacttgcccgagacctggtaggcgtcgatggtgtcgtccttgccattgcgcagggtggtatcggacaggccgatgaccgacgaatggaagtaggcgaacgacacggcatacgggccggaagcgtactgcagacccacgtcgtaggcggtgccgccgaagtcgagctggccgccgccggtgcccttgccgccgtaggtgccggcctgcgaggtgccggacagcacggcgctggtcacgccgccctgcttgcggtcgtcagaggcgcgctgcaccgaaccacccagggtgaagccggcatacgacagctgagcgccgtaagcctgctgggtcagggccttctcggcgccgccggtgccggtcaggtcgacccacacgtagccagccgaagccttcacgccaaccgggccgaaggtgttggtgtacagagcgccgccgccccaagcgccgagacggtcggaaccgttgccacggccgtgctggcccaggccagtcgcgcccgaacggacgacgttcgggatgtacgaagcgccgagggtcaaaccgtagaaggacggagcaacgtaggtcagcttctcggccttgtcatcgctgatgatggcggtggtgttggacgagacggtgtagccaacgcgctggttcatgcccatcacgccagccggcttggtgatggcccagttgcccatcatcatgccgccgttggtgaagttgccggcggcgtcgggggcctgcacgtgcagcagggcggtgccgttggcgtggataccggccagcaccttaccgaagccaccctcgatccaggcgtagctgttgtcgatgttgtcggtgacggtgtcggagtgaccaccggcctccagggtgaccatgacgccgaccttcaggccgttgtccagagcggtcgagcccgagaaccaaatctcgttgtcgcccttgacgtcaacgttctgacgcatggagcccgacgaggtggagccgttggccgaaccaccgatggtgccggtggcgccgttctggaagcccttgtcctgccaggcaccgacgacccaccacttggagtagccaccaacgttcagcttgatcttctcggcggcggaagcggcgccggcgctcagcatgccggcggcgaccagcgcggtactggtcaaaagaatcttcttcatggtatctcctctctttggctttgcgaaaacgacccccaatggccgcgaccgctatccaaatgaacgaacggtcgccatcacgccatgatgggcgccgccagtcaagcgaggcgggacgtcggctgtatcgaaaactccgcactgtggcatggatgccacacaacacccttccaccggcgaggcggcgttaccgcttgcaggcgatgcgcctctcgtagcattcttgcccgtcgcgatggcgggtctcgccgtcggaggtatttcgcgtgccaacgggccgcgcgtcggcgtggcggggtgaagacggtgatgacgagtaagatttcgatgagtggtctgggtgccctggtgctgctcggcgccaccctggtgctgtcgggctgcggtgagtcccaggcggtctttccgaccaaggaaaagggcgacgcggcaccgcgcatgtccaatgaaaagcgcgagaccatcttcggtccggaaggcctgttcggcaagagcaagcccgagggcgagggcgtgggcatcggcgtcaacgccttcttgtggcgagcgtcgcttgataccgtgtccttcatgcccatcaccaccgccgacgccttcggcggcaccatcatcaccgactggtatcagctgcccgagacgcccagcgagcgctataaggtcaatgtcttcatcctggaccgcacgctgcgcgccgacggcgtcaaggtgtcgctgttcaagcaggtgcgcgacggagccggcaactgggtcgacgtgcgcgtcgatcccaagatgaccgccgacctggaaaactcgatcctgacccgcgcccgccagctgcggatcgtctcgaccgaatagagagggcgaccgggcggcctggcgccgtccggcccgatcttttacctcatcccaccagaaacaatggacggccccatgtcgcgcccggatggcatcagcggcgaccgctataacgtcaaggaaaccgaagcccgctggcagcaggcctgggaagcgaagcgctgcttcgaagccgagatcgcgccgggcaagcccaaatactacgtgctggagatgtttccctatccgtcggggcgcatccacatggggcatgtgcgcaactataccctgggcgacgtggtggcgcgctataagcgggccaagggcttcaacgtcctgcatcccatgggctgggatgccttcggcctgcccgccgagaacgccgccattcagaataatgtccacccggccaaatggacgcgcgagaacatcgcggccatgcgcgaacagctgaagtccatgggcctgtcctatgactggcggcgcgaggtggccacctgcgaaccggaatactatcgccacgaacagaagatgttcctggacttccttaaggccgggctggtctaccgcaaggaatcctgggtcaattgggacccggtcgagaacacggtgttggccaacgagcaggtgatcgacggccgtggctggcggtccggggcgctggtggaaaagcgtctgctgtcccagtggttcctgaagatcaccgcctatgcccaggatctcctggacagtctggccacgctggagcgctggcccgagcgggtgcgcctgatgcaggagaactggatcggccggtccgaaggtgcccggctgatgttcgatctggacgggcgttccgaccggctggagatcttcaccactcgccccgatacgctgttcggggccaagttcgtggccattgccgccaatcaccccctggcggccgaactggcggcgggcaatccggcgctggccgagttcgtggccgagtgcaaccgcatgggcacctcggaagcggccatcgaaaccgccgagaagaagggcttcgataccggccttagggccgtgcatcccttcgattccacctggaccctgcccatctacgtggccaatttcgtcctgatggattacggctcgggtgccatcttcggctgtcccgcccatgatcagcgcgacctggacttcgccaacaagtacggcctgggctggacccaggtggtggagccggcgtccgacggccaggcggttctcgccgccatcgccaagggcgaggcctataccggcgacggcgtggcggtcaattcgcagttcctcgacggtctggcggtggacgaggccaaggccgaggccatccgccgcatcgaggagatgggccgcggcgagcgtaccatcaattatcgcctccgggattggggcgtgtcgcgccagcgctattggggctgccccattccggtgatccattgcgaggcctgcggcaccgttccggtacccgccgagcaattgccggtggtgctgcccgaggatgtcagcttcgacaagcccggcaatccgctggaccaccatcccacctggaagcacgtggattgcccgtgctgcggcaagcccgcccggcgcgagaccgacaccttcgacaccttcttcgaatccagctggtacttcgcccgctacacctcgcccgacagaaccgacgtggcgttcgaccgggtggcggcggattattggatgagcgtcgaccagtatatcggcggcatcgagcatgcggttctgcacctgctgtattcccgcttcttcacccgggcgctgaaggattgcggctacctgaacgtcaaggagcccttcgccggtctcctgacccagggcatgatctgccacgagacctacaagtccgaggacggcgcctggctgttccccaccgaggtggtccccggcgccgacggcaagctggtccatgccgagaccggcgcgccggttaccggcggccgctcggagaagatgagcaagtccaagaagaacgtggtggaccccgccggcatcatcgacggctatggcgccgacacggcgcggctgttcatgctgtcggattctccgcccgagcgtgacctggactggaccgaggccggcatcgacggcgcctggcgctacgtcaaccggctgtggcgcatggtggccaccgccgagctgccgccggccggcgcgcccatgccggagctgtcgcccgaagccgccaagatccgtcgcctgctgcacaagaccatcgcccaggtgggtgaggatctcgagcgctttcacttcaacaaggcggtggcccgcatccgtgagatgaccaacggcctgggcgagctgccggccggcgattccggggcggcctgggtgctgcgcgagggtctggaagccaccgcccgcctgatcggtcccatgatgccccatctggccgaagagatgtggctggccctgggcggttccggtctgctggccgaggccgcctggcccgaggccgatccggccctgctggtggaggacagcgtcaccgtggccgtccaggtcaacggcaagctgcgcgccaccatcgagctgcctaaggatgtcgatgccgctctggcggaacagacggctcttgcgcaaccccaggtgatttcggcaatgtcaggaaaacccgcgcgcaaggtcgtggtcgtgcccaatcggatcgtcaatgtggtggtctagagcactccttctgtttgctgttctggtgctgggtccggtgggctgcggcttccggcccatgtacggtacgccaagcggtgcggcttcgggcgtcgatgccgatttggcaacggtccgcatcgaacccatcaaggaccgtaccgggcaacaactccgcaatgccttgttgcagcgcttgtcgccccggggcgaagccgccgattatgcctacagccttcagatcaagttgaccgagaccgtcaacaatctcggattccgcaaggacaccttcgccactgtcgccaatatgtccattaccgcccaggtccaactcagcaaaaatggcggaggattgatcctgggcgataacgtcacgacgacggtctatttcgactatctcgggccgcgctatgccagcgtggccaccgagcgcgacgccgaggagcgtaccctcagccagttagccgacgatatccgcaaccgtgtcgccctagcgattcagcgctatcaggccaaccccaacgacgagcgatatcggcagcgctccttgtttctcgacgacatgggcggggggcgtcggtgaaactgagcggggcacgggtggaagcatttcttaagtcacccgacccctccatccgcgccgtcctggtgttcgggcctgatctcgggctggtacgcgaaagggtgcagcgattgatccgctcggtggtgcctgatgcttccgatcctttccgggttgccgagctgactcccgccgcgctgaaggaagtcccgtcgcgcctggccgacgaggccgccgccatggccctgggcggcgggcgccgcgccgtggtgctgcgcgatgccggcgacggtcaaagcggagcggtttcgtcctttctggcccggcccatgggcgacgccctggttgtgatcgagggcggggaactggggccgcgctcgtccttgcgcaagctgtttgaaggcgccgacaacggtgcggcgctggcctgctacggtgatgaaggcggctcgctggccggggtgatccaggaggagctgaaggccgccggactgatggccgagcccgatgccatggcctatctcaccgagcatctgggcggcgaccgccgcctgacgcgggccgaactgggaaagctggcgctgtacatgggcggacccggccgcgtcagtctggacgacgcggtggcctgtgtcggcgataccgccgcgctgggcttggacgatctggcgctggccaccgctgatggcgatcatgccggggcgcagcgcgtgcttgaccggctgctgcgggaaggcggccagccggtgggcatgctgcgctcggtggcccggcacttccagcgcctgcatctggccgccgggttgatggctcagggcaagtccaccgatcaggccatgtccgcactgaagccgccggtgatcttcaaggccgccgatcgcttcaagcgccagctgtcgcgctggcccgccgaccggctgggcaaggcgctggatctgctgaccgaggccgaggtggattgcaagaccacgggcatgccggccgccgagatcgcctcgcgggcactgatgatgattgcccgagcggcggcgagacgctgatggcggccaggacttccatcgggcgtctgatcgccatcaatctgggacttctgctggccgggcttttcctggccgaactggtgttcggcagctggattttcggccccagctggggaaccatgaacattccccgcgacatacaccggatgttcgatgtcagcgggctctacaatggccctagggacgccatttattcccgcgacaaatgggggctgcgcggcgcctaccgggatctcggcgccatcgacatcctgaccatcggcggctcgaccaccgaccagcgcttcatcggcgacggccagacctggcaggattacctggcccaggatctgggcggcagggtggtggtcaatgccgggatcgacggccagtcgactctgggccatctgagggccttcgaccgctggctgtcccagattcccggcctgaagccctgcttcgtcctggcctatatcggcgtcaacgacgcccatctggaaggccagcagcaatgggacgacatggcgtcgccctctctcggacgccggatcgagcgctacatcaccaatcattccgccctggttcaggtggtcaccaccatccaggggacgttgaaggcccgcaaggcccatgtggtgcacggcgggaccgagttcgcgcgggggccttgggtcgccggaccgcctccggatttggacaaggtggtggcttccgctctgctggatgcctacgaacagcgggtcgaggccctgatcgcccgcattcgggcggcgggggccgaggccatcatcgtcacccaaagccgttccgactatcgggtgactggcacgggcgagccgctgggccgggccaaggcggcgaattccgtggatttcggctcctgggccatgcagaccgcctttaaccgccgggccatggcggcttgcacccgggcaaacgcggtttgcctggatctgggcagcggattgaccttcgaggacggtgacttctacgattgggtccacaccacgccgacggggaatcgccgcatcgccgcatggcttgctccccttctggctccactcctgcaatagagcgctgaattcgaagactattcgattcggttggcgtcttgtagaaaccaggaaacacccccattcttctctaccagaggcagacgcagactctgtcgacagaggggggccgggccgtggaaatctctgcttatctggatcggcgcatcgccgaattgtccgaacccttggccaaggtcggcgccgggcggctgatccgcgcctatgcggccggaatccccctggccgatctggccgaggccgatcccgaactggtctatggcgccgcgctcggcctgttcgccttcctgcgcgaccgccagcctggggcgccatccatccgcgtcttcgacccggatctcgatcgccacggttgggtgtccagccattcggtggtggagatcatcaacgacgatatgccgttcctggtggattcggtggccatggagctggcccggcgcggcatcaaggtgcacctgctggtccaccccgtgttgcgggtcgatcgcgatggtgccgggaccctggtccaggtggcggccaatgggtcgggctcgaccccggaatcggtcatgcatgtggaaatcgaccggcagccggcggaggtccagacgcagctggccgagtccctggccgaggtgctggcccaggtccgtcttgccgttgccgattggcggcgcatgctggagaccctgtgggcgggggtgacggaattcgagaatgcctcggccaaggtcccggcggacgagaagcaggaagccctggccttcctggaatggctggccgacaaccacttcaccttcctgggctaccggcgcttcgatctggccaagggcgtggtcgccgatcccgccagcggcctcggcattctgtccgacgccggcgcccatgtgttcgacgacaccgtgaccctggccgacatgccggccgaactgcgcgccttcgtgcagcggcccgatccgctgatggtcaccaaatccgcccgccacgcggtaattcatcgtccagtgcgcatggacatcatcgggctgaagcagttcgatgccaaaggcaaggtggtggggttgcatgccttcctcggcctgttcacctcggctgcctataatgaccggccggcgcagatccccctgttgcgccgcaagatcgcccgggtcgaggcccgtgccgacttcaacaagtccggccatgacgccaaggcgctgatcaatatcctggagacctaccccagggacgagctgttccaggtctccgaggatgccctgttcgaaatcagcatcggcatcctgcatctgcaggatcgccagcgggtggcggtgttcctgcgcaatgacgagttcgagcgctttgtctcctgcctggtcttcgtgccccgtgaccgctacgacacgccgctacgcctggccgtcaccgccatgctggaagaggcgctgggcggcacgctcgacaccttctacacccaggtggccgacctgcccctggcgcggctgcatttcatcatccgcaccacccccggacacctgcgccgcgtggatgccctggcgctggaggtccgcatcgccgacgcggcgcgcacctggcacgagcacctgcaggacgctctgatccagactcatggcgaggccgccggcctcgccctggcccggcggtggggcaagggattccccgcctcctaccgcgaaagccacggcgccctggcggcggtggccgatgtggggcgtatccagacggcgtcgggcggcgatatcgttctcaatctctaccgtccggtggaggccgagcctcgccagggccgtctgaagctctaccgttcgggccagccggtgccgctgtcgggcatcctgcccatgctggaagccatggggctggtggtcatcgccgaggttccccacgagatcgagccggattccggcggctcgacggtgtggattcatgatttcgaggtggaaagcgccgatggcgcccccctcgacgtggccgagcggcgcgagctgttccacgatgccctggcggcggtgtggcgaggcgacgccgacagcgacggcttcaaccggctggtgctgtcggccgggctgtcctggcgcgagatcatggtcttgcgcgcctacaccaagtatctgcgccagaccggcatcacctacagccagacctatatcgagcaggccctgggcggcaatgccgacatggccaccggcctggtccgcctgttcctggccagtttcgaccccaaggggcggtccggcgacgcctccgaggccgaggcggcgctgctggcgggcctggacaaggtggtcagcgccgacgacgaccgtattctgcgccgcttcctcaacctaattcgttccactttacgaacgaattacttccagaccgatggagcgggcaagcccaaggcctatctatccttcaagctggattcccggcaggtggacgatctgccggcgccgcggcccctggtggaggtcttcgtctattcgccccgggtcgaggccattcatctgcgcggtggcaaggtggcgcgcggcggcatccgctggtccgaccggcgcgaggacttccgcaccgagatcctgggcctgatgaaggcccagatggtcaagaacgcggtgatcgtgccggtgggcgccaagggcggcttcgtggtgaagaagccgccggcggccggcgggcgcgaggcctacatggccgagggcatcgagtgctacaagaccctgatgcgcggtctgctggacctgaccgacaaccttgttccggaaggagtcaggccgcctcccgacgtcctgcgccgcgacggtgacgatccctatctggtggtggcggccgacaagggcaccgccaccttctcggacattgccaatgcggtctcgctggaatacggccactggctgggcgacgcctttgcctcgggcggttcccagggctatgaccacaagaagatgggcattaccgccaaaggggcctgggtggcggtggaacgtcatttccgcgagatgggcatcgacacccggtccgaggatttcacggtgatcggggtcggcgacatgtcgggcgacgtgttcggcaacggcctgctacgctcgccccatgccaagctggtggccgccttcaaccacgcccatatcttcctcgatcccgatcccgacccgcaaaagaccttcaccgagcgggaaaggctgttcaatgcggtcaaggcctggcccgattacgacctgtcgaccatctcgccgggcggcggcatctggccgcgcagcgccaagtccattcccatcagcccccaagccaaggcccgtttcggaatcgaagcgaatagcctgactcccaccgagctgatccgcaccctgctgaaggcgccggtagacctgctgttcctgggcggcatcggcacctatgtgaaggcgtcgggcgagagcaatgccgatgccggcgaccgcgccaacgacaccctgcgcgtcaacggctcggaagtcggcgccagggtggtgggcgagggggccaatctgggcttcacccagttgggccgcatcgaatacgccatcagcggggcgggcggcggcggcgggcgcatcgacaccgacgccatcgacaattccgccggagtggattgttccgaccacgaggtcaacatcaagatcctggtcaacgacctggtcgcggcgggcgatttgacgccgaagcagcgcgacaagctgctggccgagatgaccggggaagtgggggctctggtgctgcgcgacaattacctccagacccaggccatctccatgctggaggcccagggggccgacctgctggatgccgaggcgcggttcatgcgcctgctggaaaagggcgggcgtctggaccgggccatcgagttcctgcccaccgacgagacgctgaccgagcgcgccgcccgcaagcagggctttacccgcccggagctggcggtgctgctggcctatggcaagatctggctttacgaccacatcctggcctcggaactgcccgacgatccgttcatggccatcgatctcaccaattattttcccacccagctgcgggatcgtttcggtcacgaaatccagcgtcaccggctgcggcgcgagatcgtcgccacggtggtgaccaattccatcgtcaaccgggtgggcggcgccttcgtctcggaactgatggagaccaccggccatccgccggcccaggtggcccgggcctatatcgtggcccgtgatgccttccgcatgcgcgaggtctggcgggccatcgaggagttggacggcaaggttcccgccgccgcccagaccgccatgcagaacgaggccaaccggctggtggagcgggccacgctgtgggtgctgcgctccatgccgtcgcccttcgccttgggggcgggcatcagcgagctgtcgcccggcgtcaaggcgctggaaggcgccgtgccggccatcctgccgcccgatgccgccgccgccgtcctggcccgcatcgatcatttcgtcggtcaaggcgtgccccacgatctggcccagcgggtgggcaatctgatcgtcctggcctcggccgccgatatcctgcgcatcgccacccgccagaacctgtccatcgagacggcggggcggctgtatttcgccgtcggcgcccgcttctcgctgggctggctgcgggcttcggccgaaaagctgtcggggcgcggccattggctcaaactggccgccgccgccgccatcgaggacctttatggccaccagcgcgacatcaccagcgtggtggcggcctcctatcccgacctggagcccgatgcggcggtccaggcctggctggaggccaaccgggcagcggtggagcgggccgagaccctgctggccgagctgaaggcggcgtcgcatatcgatctgtccatgatcatggtggccaatcgtcagctgcggaccctgacggagtcgggtgttgcggtctcgggcgggaacggctaagggaaaggcatcaacgacatgagggccgcgccatgaagtttgccacctttctcgatcagcaaatcgcggaacatgccgagactctggccgttaccggcgcagcggtgcgcgagcccttccagcgcctggtccaggcctgcgtcgacagtctggcggcgggcggcaagatcctgttcttcggcaatggcggatccgccgccgatgcccagcatctggccgccgaactggtgatccgctaccgctacaaccgcaaggccctagcggccctggccctgaccaccgacacctcgaccctgaccgcctgcgccaatgatttctcctacgaggagatcttttcgcgccagatcgaggccctgggccgccccggcgacgtggccatcggcatcaccacctcgggcagcagccccaacgtgctgaccgccctggcggtagcccgcgacatgggtcttgtcgccgccggctttgccggccgcgacggcggcaagatggtcggtctggccgatccgctgctgatcgtgccgtccaacgtcaccgcccgcattcaggagatgcacatcctgatcggtcatgccttgtgcgatcaggtggaagcggtggcggctccggcctgagcggtttgccaccacggccggggccgtggtaaaagtccggcaccttatttccagtggacgcgttccaggcatgagcaagtcacagggtgccattgacggcggttcccacggccgcaaggtcgagatgggatcggaccggtccttcgggctggtcttcgcggcggtgttcgccatcgtggcgttgttgccgctcaaggacggggccgagccccgcctgtgggccggggcggcggccgggctgctcctgctggtcgccctggtgtttcccaaggcgctgaagcctctgaacaagctgtggtttctggtgggcatggcgctgcaccacgtggtgacgccgctggtcatggggctgctgttcttcgtcaccgtcacccccatcgccctgatcatgcgcgccctgggcaaggacccgctgcgtcttgcccgtgatgacgccgccgtcagctattggatcaatcgcaccccgccgggcccggcgcccgaaaccatgcggcgccagttctaggagatcgacccgtgagctttcttatcgagctttggcagtttctgcgcgagcgcaagaagttctggctgctgcccatcctgatcatgatggtggtgttcggcggtctgatcgtgctgtcgcagggctcggcggtggcgcccttcatctacaccctgttctaaggctgttcctttgcgcatcctcggcctttccgccctgtatcatgacagtgccgccgccctggtcgaggacggccgcatcgtcgcctgcgcccaggaagagcgcttcacccgcaagaagcatgacgcggcctttcccgagaatgccatcgcctattgtctggccgaggccggaatcggcctggccgaggtggatttcgtggtgttctacgacaagccgttcctcaagttcgagcggcttttggaaacctatgtggccttcgcgcccaagggcttttcctcgttcaagaccgccatgccggtatggctgaaggagaagctgttccagaaggatctgctggcccgcgagttcaagcgctttgcccccggtttcgactggatgaacaagctgctgttcgccgagcatcatctcagccacgcggccagcgccttctttccctcgcccttcgaggacgcggcggtgctgaccatggacggcgtcggcgagtggaccaccacctcgctggccatgggttcgggcaacaggctggagattcacaaggagctgcacttcccccattccctgggactgctctattccgccttcacctactacacgggcttcaaggtcaattcgggcgaatacaagctgatgggcctggcaccctatggcgagccgaaatacaccagcctgatcctggataacctgatcgacctgaaggaagacggctccttccgcctggaccagtcctatttcgactattgcaccgggctgcacatgaccaaccagcgcttttcggcgctgttcggccagcccgtgcgcaaggcggacaaggacccgctgacccagttccacatggacatcgccgcctctatccaggaggtgaccgaaatcgtggtctccaagctgtgccacggcatcaagaaggagaccggggccaggaatctgtgtctggccggcggcgtggcgctcaactgcgtgtccaacggcaaggtcctgcgcgaaggcatcttcgacaatatctggattcagccggcggccggcgatgcaggcggcgccctgggggccgccctggccggctatcacgtcttcaagagccagccgcgcagcgtgaccccgggcaaggacgccatgaagggctcctatctcggtccggtgttcgggcaggccgacatcgaggcccgtctcaccgccgccggcgccaaattcacggtgatggccgaggccgaggtgaccgaggcaactgcccaagccctggccgaggagaaggcggtgggctggatgcagggccgcatggaattcggcccacgcgccctgggcggccgctcgattctgggcgatccccgctcgcccaccatgcagaagctgctcaatctcaaggtcaaataccgcgaaagcttccgtcccttcgcgccttcggtgctgcgcgaggacgtggcggactggttcgacctggacggcgattcgccttacatgctgctggtggcgccggtggcggaaaagcatcgccgcgccatgaccgaggacgagaacaagctgttcggcatcgacaagctcaacgtgccgcgttcggccattccggcggtgacccatgtggattactccgcccgggtccagactgttcatgccgacaccaatccgcgctatcacgccctgatctcggcgttcaaggcgcggaccggctgcggcgtggtggtcaataccagcttcaacgtgcggggcgagcccatcgtctgcggccccgaagatgccttccgctgcttcatgggcagcgagatcgaggtgctggtggtgggcaattgcttcctccgcaaggaagagcaggacccggcgctgaagctggactacaagaacgccttcgaactggattagcccgtggagggtgggggacggcgatgaggctgtggcggaccctgcgtcatctgcgtcccgctcaggtgatccaccgcctgtggtaccgggcgcgcctgccgtattttcgtacggcgctggcctcgactcgcctgggtgaggagacggccgccccggttcttgcgctgccctccgccccggggaatgaggcgaacggacgcctgatcctgaccggccgggtcaggctggtggggctggagggtccggccaccggatggaccgaacccggtctgccgctgttgtggcgctttaccctgcattacttcgaatggctggccgatctgcgcgtcctgggcgacgagggccgagagccggcccgtgccctggtggcccattggctggcgcgcttcgaacgcttcgacccggtggcctggcacccctatcccctgtcgctgcggctggtgtcgtggctggcccatgccgagttcctgtgccagggggcggaggccggctttgccgaagcctttcaccgctccctgcaccgtcaggctcggcacctggagcgggtgtgggagcgtgacgtgggcggcaatcacctgatcaagaatctcaaggccgccattgccgccgccgtgtgcctgccgggacaccgggcgggtctggccagggcgctggaggtccttgagcacgagatagggcggcaggtcctgcccgacggttgccattacgagcgctcgcccagctaccatttccaggtgctgggggacctggaggatctggcggcgctggtgcccgagccgcctgccattctggccggggccatcgggcgcatgcgcccggcggcggccttctttgtcatggcgcccggcctgctggcccagttcaacgacggcactgccgatggtccggcggcttcgcccgaagggccggtgcccgccgccctgcccgccgcgggatattggcggctggaagccggcgcggcgcggctgctggtggattgcggcccctgctgccccgacgacctgccggcccatgcccatgccgataccctgtccttcgagctgttcgacggcgaccatccgctggtggtcaattgcggcacctatgcctaccaggatgcgcaatggcgcaaccgtttccggggtaccgccttccactccaccctcagtgtcgatgagggtgacagtgccgaggtctatggcggctttcgcctcggccgccggccggaacgtttcagggtagaatgcgcgggagggcggttctcgggggaattcgacggctggagccgcctgggcctgacccacggtcgcaccctgagcctgggggagggggggctggagggaaccgacgaggttaccgcctcgcgccccggttcatcccacactctgacggttaggttccaccttcacccttcggtgacggcccggcgggagggcgacgagatcgccttggtgacggcgggtggcgcccgctggcgattcgccgccccgggcctgaccctatcgctggccgagtcccgctattccccccgtttccacgaaatgcagcccacgctctgcatccgcctggacttgccgttcagcggggagaaggcggtcttgccgtggcggttctaccgcccgtaatcgtcctcgatgcggacgatgtcgtcctcgcccacatattcgcccgactgcacctcgatcagccgcagcggcaccttgccggggttttccagccggtgattgctgccggcggggatgaaggtggattcgttctcgcgcagcacgaaggtgttgtcgccgcaggtgaccagggcggtgccgcgcaccaccacccagtgttccgagcgatgccagtgcttttgcagcgacagcttggcgccggggtccacgtggatgtgcttgaccttgaagcgctctccctgctcgacggtctggtaccagccccaggggcgccagccgcgggtgccctgggtggcttcgggccggccttcgcgcttcaaggcctcgacgacagccttgacctcctggtcgcgggccttgtcggccaccagcacggcgtcgtcggtggcgatcaccaccatatccttgaggcccaccgccgctaccaggcggccctggctgcgcagatagcagcccgagctttccagggccagcacgtcgccctgaatggcattgccgtcggcgtcgtggctggtctcctgccacagcgccgaccacgagccgatgtcggaccagcccatgtccaccggcaccaccgccaccttgtccgacttttccatcacggcgtagtcgatggactggccggcgatggcggcgaaggccttgtcgtccaggcggaagaagaacaggtccgagcggccctggtccagggcggccttgcaggattcggccatgccgggagcgtggcgggacagctcgtcgaggaacagccggaccggcagcaggaagatgccgctgttccaggtgtagtcgcccgatgccacataggtctcggcggtggcgaggtcgggcttttccacgaagcgctcgacctcgaacccgccgtccagcgccttgccgcgcttgatgtagccgtagccggtattgggattggtcggcgggatgccgaaggtgaccagccgcccggcctcggccaggggtacggcggcctccagcgcccggtggaaggcgggcacgtcggcgatcagatggtcggacggcatcagcagcatcagggcatcgggatcgctgtcggccagcatcagggcggccaccgccgccgccggtgcggtgttgcgtccgaccggctcgatcaccacggcgcggggctccaggcccacttcgcgcaattgctcggcgacgatgaagcggtgctccacgttgcagaccaccacggggggaacccctaagcgcccggccgtatcctgcagcagagtccgctcgccggtcagcttcagcagttgcttgggcatcagctcccgcgacagcggccatagccgggtgccggcgccgccggacaggatgacgggaatgagggtggtcatggcttaactctccttgttccgccaccatcgggcggtggcggtcagtccttcgtccagggtctcgggcggcacccagccgatggccgccgccagggcggagccatccacctccagcgaggcggtcagtcgttggatggcggcgcccttgcccagcaggccggcgcccaggcgcatcagcccgacgggtatgggcagcaggcgggccgggcggcccagcgcccgggcgaggctgcgcaccagatctgcggtgctgggagcctcggcgtcgcacagggtgaagacccggcattgcccgggatggggaggctggtccagcacggcgcggatggcgtccaccagattgcccagcccgatcagcgagcggcggttatgggtgcagcagcccagcggcagcggcaggccccgattcaccagcctgatcagcgcgcggaagttgcccttgacccccggaccatagaccaggggcgggcgcagtaccgtcaccgccagtccggtgcgcgccgcgatctcggccagaccctgctcggcctccagcttggagatgccataggggtccactggggcggcgttcagggggccgaacggcgtgtgggtggtctcctcgccattggccttgatggagctgaggaacaccagatggccgattccggcctgggccgcctgctcggccagccgcagggtccccgccccattggcggcacggaactcggccagaggatcatgggaggcgtcgtgcatcacatggacgcgggcagccagatgcaccaccgcctgcattccctcgagggctgcgctccaattcccgtcggcgaccagtcgtccggccgggcggcgctcgacgcaatcgggcaaatagggctggcctcgcaccgcgccggcgacatggtggcccagctcggccagccgccggcacaggggctgcccaacgaagccattggcaccggtgaccaggactctcatcggcggattcctcccgcccaacgggtcatctgccccagcacgcccgccaccgccagcagtgcaagcatcaccgccgggacggtatggccgagggcggccagcagggcggcgcccgccaacaccacattgccgcccaggatcagcagcgatacccgggcatggctttggccgccgcgcacggcgcgctggtagaaatggcggcgatgggcctgccagacgcgctcgccgtccttgaggcgccacagcaaggtgatggtggcgtcggccaggtaataggcgggcaggatcagggcggcggccagctgtccggagacggccagctgcaccagcagcccgcccagcaggaagcccagcggaatggacccggaatcacccaggaagatgcgggccggatgccagttccacaccaggaagcccagggcggcggcggcgatgatcagggcgggcggcagcagcccgcccaggccggccagcgcggccacggcggccagccccaggccgatggcgacgctctccacgccggtgatgccgtcgatgccgtccatgaaattgtagagattgacgaaccacagccagcccaggccgatcagcaggcggtccgcccacaggggcagcacccccttgaacgctagggcgtcggggccgaggccgatcaggctggcggcgacgatggcggcctgggtcagaaagcgcggcaggggggccagccccttgcggtcatccacccaggagatggccatcagcaccagggccccggccgccaggaacgtgggctggccgccgacggcaaaggcagccaggatcagcgccgccacggtgaccggcgtgaccgccagcccgccaccccggggggtgggcaagctgtggctggagcgctcgttgggatggtcgaggatctgcctgtggcgcagccaagccagcacggcgcgggtggcgcccagactggcggcgaaggtggtcagcgccgcccacagggccgcctgtccgctctccgccatggtcgggatcgccgcgatggccaaccctagtcctccaggctgacccgccgcccgtcgcgcaggctttccagcacggcgatggtggcaaggctggtctcgatcagttcggcctcgtcggcgggcgccggaccgccggtggccacggcgcgggtgaaggcgtcgagctcggcgcgatggcccttatcctggcccagggacttttccgtccgggtacggccgccctgggtgatggacagcgtcaggaaattgtcgatcaccgcgactgttccgcctgcgaaacactcgaagcgttccttgctgtgggcggtgtcgccctgggcggtatagacaatggtggccagggagccgtccttgaaggtcagggtgacggaaaggtcgtcacaaccgccatgggtcacggcggcgctttcggcctggacggtggcgatgggcgatcccgccagggtgcgggccagatccatgaaatggcacaactcgcccaggacgcggccacccccttcctcggcggcgttgacccagctttccgccggcagggcgccggcgttgacgcgcagcatcagcaccttgggcccgggatggcgggccagatgggcgcgggccttgagggtcagcggcgcgaagcggcggttgaagccgatggtgaagaagccgggcgagccctggcgggcggtgatcacccggttgagctgctcgcggtccagcgccagaggcttttccaccagcaccgacttgccggcctccagcacccgcgcggtcatctcagcgtggttgccgtgacgggtggccaccagcaccgcgttgatggccgggtcgttcagcaccagatccacatcggtggtggcattggcgaagccgaaggtctgctgcccgtgctcggcggtctggccgcgctgggtgcacaaggtgcggaactccacgttgggcagccgcaccagttcgggcagcagcacggtgcgggcgaaattgccggccccgatcacccccatgacgcagcggccggcgggggccttggcggcgggaaagaccctggcctcggccctcccggccgaatggtcgccatagcccagcaccacgccgagatggggctcggcgccgccggtaaccaattgataggcgctttccgcgtcgtcgaaggcgaaacgatgggtgatcaacgcccccacatccaggcggcggggcagcgaggggctcatcagccgcacgcattcgcgcaggttctcggcctcggtccagcgcacccagcccacggggtacttgacgccgcgggattcgaaatcctcgtcatagcggccgggaccataggagcgcgacacggaaagcgtcagctccttcttcatataggcggcatagtcgaattcggtgccggtcttgcccaccagcacgaccttggcgcggtcgcgggccagttcggcggccagggccagaggttccgacgagtcggtggccgcggcgatcagcacggaatcacagccgatgccgccggtcagcgccgccaccgcctcggtcaggccgtgctcgcccagcacccaggtcagttcggcgcccatggccttggccagggccagtcgttgcggattgacatcgagcgcgacgacccgggcgccctgcagcgccagcaactgaaccgccaactgtcccaccagcccgacgcccagcaccgccaccacgtcgcccagttgcgcccccagcgagcgcatgccggccatggcgatggagcccaccgtgccgaaggcggcctcctcgtcggtgacgtcgtcgggaatggcagccaccagattgcgcggcaccacgttgagttcggcgtgattggccagaccggctccggccatggccacccgctggccggtggtgaaggcgccctccagcccggctcccaccgccgagatggtgccggcggcggaataccccaggggcaagggctcatccaggcgggccatcaccgccttgaaggtggagatcagcccgtcgcgccgcgccttgtccagcaccttgcgcaccaggtcggggcgggccgaggccttggcggccaggcttttgcgggcgaaatcgatgaccatgcgctcggtgccggcgctgatcagcgaggcccgggtggcgaccaggacatgaccggcccggaccctggggtcggggacctgcttcagggagagcttgccgctgcgggtgctttggatgacttgcttcatgacgggccttatagcagatcggacggccggacgcgtccggtcttcaacagatggcggagcacctgggctacctgacgggcgtcgcccagggcgtcgtgggcgcgctggtcggcattcaggccgaaggtggcggccatttcgcagctgtagatatgggcctgggcgcccgccgccgtgatcagcagtggcgccaggtcgcggcagcgcccgtcgaagggaaaggcgcagcctgtcagggcgcaattctcgcgcaggacgccttcatccgcgccgttggagcccagatcggctccggcggcaaagtcggccagccggcagagggcttcgggaaagtccatgccggcacggtcgacctgatcctgggtgatgccggtgagatcggtgaaataggtgcttaagcctggattgaggcggggcttgaccagcagcgacagctcggcgccgtcgtccaggcgaacggccccgacctgcaccacctcgcgatgttcgccgggtccggaccatcggcgttcgcgcgccccctcccaggtggtgtattccagatcgtagaccacgacacccgtcacctttgccaccctggcccttgaggtcgaccctgaggtactgaagcgggtaggtgatgtcaagcaaaggcctagcctaggtcgatcccggcgcgatatatacgggccacccttcttttgcgggaaccacgttccatgtgcggtctggccgccatcttcgcctatcagtccaaggctcccccggttcagggtgacgaactggccgttgtccgcgacgccatgcgactgcgcggtcccgacggcgccgccagctggatctcgcccgacggccgggtcgggctggcccaccggcgcctggccattatcgacctatccccggccggggcgcagcccatgaccagcgccgacgggcgcctcgccctggtgttcaacggcgagatctataattaccgggccttgcgggccgagctggaaagtctgggtaccgtcttccgctcccacaccgataccgaggtgatcctggagggttggcgccattggggccgggacgtgctgtccaggttgcgcggcatgttcgccctggcgctctgggacaacgaggccaggggcatgttgctggcccgcgatcccttggggatcaagcccctgtacatggccgaccagggcggttgcctgcgggtcgcctcccaggtcaaggcgctgctggccggcggcagcgtcgacaccacccccgatcccgccggtcatgccggcttcttcctgtggggccatgtgcccgagcctcacaccctgtatcgggctatccaggccttgccggccggctcgtggctgtggcgcgacgaagcgggcgggcgcgacgaaggccgcttcttcgacctgggccaggagctggcggcggccgacgaaaaaagtttcgatatcgatatattgcatgaggctctggccgatagcgtcaaggcccatctggaagcggacgtgccggtgggcctgttcctgtcgggcgggctggattccaccaccctggcggccctggtgcgcgaggcggccgaggggccggtgaagtccatcaccctgggcttctccgaatttcagggcggcgcccaagacgaagtgcccctggccgagcgggtggcggcccattaccgcctgaatcacaccaccagtcgggtgacggcggccgatttcgcccaggcgcgggatcaattgctggcccatatggaccagcccagcgtcgacggggtcaatacctggttcgtggcccgcgcggcggcccggtcgggcctgaaggtggcgctgtcgggcctgggcggcgatgaactgttcgccggctatgattcctttgcccagattccccgtctggccggagccttgggacccctgcggcccctgcgcggcctggggacgctgctgcgcatggcgctgagcccgtggatcggccgctttgcttcgcccaagacggcggggctgctggagtggggcaccagcttcggcgacgcctatctgctgcgccgcgccctgttcatgccctgggaactgccccgggtgatggattccgacatggcgcgggagggctggaaggctctccaggctccgtcccggctggaggcggccaccgccggcatttcgtcggcgaggctgaaggtgtcggcgctggaagccggtttctacatgcggaaccagttgctgcgcgacagcgactgggcgggcatggcccattccctggaaattcgcgtgccgctggtggatgtggacctgctgcgcgccgtgctgcccctggtccgtggcccccgtccgccgggcaagcgcgacatggccgcctgcgcccgtccggccctgccgcccgaattgctggaccgtcccaagaccggattcttcgttcccgtggcgcaatggctgggggcctccagtctgcgcggttgggcacgtcaggtgcacggggcctttcaggcatgagcggcgtgctttcccccaccaccttggatcagatggcctgggaagcggctttggcgggcttcgcgggcgccagtctcctgcaaagctgggcctatggcgccgccaaggtggacgagggcggctgggacctggagcggctggactacagggaggccggcaccctgtcgggtatggcccaggtgatggtccggcgcctgcccttgggattgggcggcctagcctggatcaaccggggtccgctggtggcggccggtcatgatcctgccccgatatttgcggccctgcgccggtggtttggccgccggggcttctatctgcgtgtcgcaccggctttggccgatcaagtcaccccgccggggtttcgtccggctgggcgaccgggctgggcttcggccttgctggatatcacccccgaagaggccgatctgcgcaagggcttgcatggcaagtggcgtaacactcttaacaaggcggaacgggaaggacccgcgatctcgggcgccgagaccgatcttgccgattttctggccggctacggtcgctttctggcggaacgcagtgttccgaccaccgtgacgccggccttgttggccgctcttcatcgccatagcctggagcatttgcgccctttggcttatgtggcccgtcaccaggatgaggtggtgggcggcgtcctgatggcacgctatggaaaaggcgccgaatatctggcggggtatggaaccgaggccgggcggcgcctgggcgtcggtcaggcgctgctgtggcgggggctggtggatgtgaagcggcggggcgcggagtttctcgatctgggcggcctggaccccttacggactccggccggcatccgggatttcaaggaaggggtgcgcggcgttccctatcggctggccgaggaactggaatgcctgggacctaatcccctggctcggctggtgcgccgcaaggtggcccgcagtctcgccctggccgatggggcgccgtcatgagcctgcgccgcgtcgccgcgcctctggccttggccgcctggcgagccacgggctttctccgccccaatccgcccggcgcggtacgcatgctgatcctgcacgacgtgcccagggtgcaatttcctgccctggcagagctcattgccggactgcaacgaaatgctggcctgatcacgcccgctcaagccgaagcccgtttgggcgggcacgcgccccccgatggcaaggctccggtcctgctgaccctcgacgacggtttcctttccaatttccttgtggcccgggagattctggacccgcagggaatcaaggcgctgttcttcgtctgccccggattggtggatatgaagcaggcggatcggatcgcggccattggcaccaatgtctttcgtggaagacgcggcgccgagggcctggacctgatggattgggaacagctcaaggagttggccgcgtcgggtcacgagatcggctgtcactcggctcggcatgttgccctggccgggctccaggcgggggtgctggaaggcgaggtcgggggcgccaaggcccgcatggcggcggttttagggcgggtgtcgtcctggttcgcctttcccttcggcgatgtggccagtatcgatggcgctgccctcggagccatcggccggcatttcgccctttgccggtcaggcgtgcgcggcttggcccatgccggcagccacccgctggccctaccggcggaatcagtggatttgggggctccgcccgcactgcgcctgctggctgccgaaggtgggatggcccccctctatggcggccgtctgcgccgtctggaggggatggcgccatgatcaccggtgcgccgttgccgagttggagggagctgggcgcgctgctgggcgatgccgccgacgggagcaaggcagctgcggcctggactctgcccacggacaaggccgtctggttttcccgctcggcccattccctggaggccattgcggcctcctggcagtgtcgccatggccgcctgccccggctttgggtcccggactatttttgcaacgccagcctggggccggtgcgccggggtggaatttccctgaccttctatcccgtgggcctggatctcgcgcccgattgggaggagtgtcgccgccttgccctggccgaggcgccggatctgttcctggccgtgcactatttcggtctgcccatggacatggcagccgctctcgaattctgccgccacgagggcgccttgctgatcgaggattgcgcccatgtcctgagcccggggccggggctgggggaaagtgggacgttcgtgctgtggagcccgcacaagcatctggcagtgccccagggggggctggtggtgtgccgcgaccccgacgaaggcgttgcaccctcctccggaccgtcgcctgccatgcgtggctggctgatcaagcgactggttcagaagctggcgcccggctggctgctgccgccagccacgcgccaaggtccccagcacttcgcggatgatccgcccgagggcgtggtgtcccagactccgtcccttgccccgcaggccctggccttgctggccgccgtcctacctgccctgccccgggtggcggcgcggaggcggcagaatgccctggccttgctggaggtcctgaagcggatgccggattgggagtcgcttttcgaccccggtctggtcacgccctaccggctggtcatgcggtgccggtcgccggatatcgccgcccaacgttttgatctctacagaagccagggcattccggtggaaagctggcccgatctggcgccggaggtcggggcaaagccggaataccatgcccgcgccctggccttgcggtggcatctgctgtgctttcccgtgcatcagggcctggacgcggcggagttgacccgccgatgcgccgaggccggaaagggcaaatccgcctaaggctgaaacaggcgtttcagcttgcggttgcgcatgtgctggaccatgtcccgaatgggctggcgcaatagcggcgggagcttgtgaaaagcggtgcggcatgccttgcggatggcgaaatgggcgagggcattggcgccggagcgatgctccctgaggcaggcggagagctgcctgagaaaggcttctgcctcggcgaagccccggccctgcagtttgggcaggctgcggtcgatctgctcgaacatcacggcgaattgcctgggttcaaagtgcaggaattctttctggaaggcataggtctcgtagggattggccaccagactgaccaggggctcggcatcaaccgacaaggccaggtcgatgaagcgctcgatctggtcgtaattacggctgttgacggtcatgctgaccgtgaaggtgaagccctgttcctgctttaacgcctgaagctgcttcaggttgtccatcaccaccgaccattcggctttgcgcccgcgcttgcgcagatcgccaaaggtggcgtcgtcggcggcgtcgagagaaaccgcaatcaggcccagcttcttctggcgtagctgggcgaaaattttctcatcgagcaaggtggcgttggtcacgaagaaatagcggcaacccgggtctgtctcggtctcggacaggaatttcaggacgggcttgaacaggaacggctcgccgccgaaggggaagatcacctggaagaccttggccagaccggccacctcatccaggaaggattgcggcagcttctgattctgggtggcgtcctcgcgctggaagcaatgatagcagtccaggttgcaggcgaaggaataggtgaagcgcatccagcggggcagcgactggaggctgagggcgccctcggcgaattccgtctggttcagctcggcattggcccgcgccggaccgccctcttccagttcattggtccaggtcagacgctgatagcccttgccgccatgcagcaccgggcaggtatgcgggcatatggcgtgggcgccgcggtcgcgcatctggcggcggatgtcctgataggcttcgccgttccaaatctccgtgatggaatcccggctgacattgcccaaggcggtgttgttgtcgcaacacatggtcacggtgccgttgggattgttgacctcgaaatgggtccagggatgatcgcatacgaacttggtcatgggcctcactcgggcttcgtgccacggggcacccgttcaaataagccgtcggcgagcaaaattcaccccttttctgccaagggggatcagcccttccggcggtggtgatccggttgacaaaatgacgagccatgacctaatgttcgcgccgtgaacaagcctggtgcggaaagagcctgtcggggcatgcctcccaacgaacagcagatcattctcgaccttctcagcgaagtccatcgggacagccgggcgacccaacgcgagatcgccaccaacatgggcatcgcccttggcctggccaacggctacctgaagcgctgtgtcaagaagggtctgatcaaggtctcgcaagcgccgcccaaccgctatctttactatctcacgcccgccggcttttccgagaaggcccggctgaccggcgactatctggcgcagtccttcgacttcttccgcaatgcccgcagccagtgccgccaggtcttggacgatgccgccgcgcggggttggcgccgcgtcgtcctggtcggcgcgtccgaactggccgagatcatggccctttgcgccaccggtactgatatcgaactggtcggggtggtcgatccggcggcccagggcgatgcgccgttggccggtttgccggtgctgccgtccctggcggccgccagtcgggtggatggaatcgtcatcaccgcgctgcagggggcccaggccgtctacgattcctatgcggcggaactggggcatcagcggctggcggctcccgcccttctggggctgtccacgcccgaaaacggggggcggtgatggaatcgtggttcgtggtgcatacccacgccaatgccgaaaagatcgccgccggccacctgcagaggcagcatttcgacgtctatctgccgcaatattccaagcgccgcagccatgcccgcaaggtggagtgggtgaaggcgccgctgtttccccgctatctgttcctgcgcatggacccggacctgacgccgtggttcagcatccgttctaccgtcggagtgcattccctggtctgccgtggcgggatgccggtgccgctgggacaggtgatcatcgatgaaatccgcggccgcgaggatgacagcgggctggtcagcctgggtgaagccatgcccttcgcctcgggccagcgcctggagatcgtcgagggccccctggccgagcaattggggctgtttcaggggctcgacgacatgaacagggtggtcctgctgctggatctgctgggtcggcaggtccgggtgcgggtgccgctggaggccgtgcgcgccgggtcgtgaccggcggcatggctcggacaaatccgtcgaaccagcccggtggaaggctttcacccggactgcggtagcttgcctggaacatggcttcaattaggatcgcacgtgcatatcgaacccactgtcctttccgacgtgctgatcctggagccgcgccagttccgggatgaacgcggcgtttttttcgacgccctgagcccggagatctgcgccgccgccggcatgtccgccgccttcgtgcagcacagccattcggtttcgcgcaagggcaccgtgcgcggcttgcacatccagcttccccggacccagggcaagctggtgcgggtggtgcggggctccgtcttcgacgtggtggccgacgtgcgcccgcaatctcctaccttcggccgtcacattcatgtgcggctgtccgccgaaaaccgccgcatgctgtgggtcggtcatggccttgcccatggctttatggcactggaagacgacagcgagatgatttatgccctggacgatgtctatgatcccggcggccaatggaccatccgctggaacgacccggatctggctatcggctggccggatctggagccgaatttgtcgcccaaggacgaagccggcctgaccctggcggcatttgccgcggcggctggccgccggagatgagcaatggctgatttcaatatctgggaaggcgtgtatgagagctttgcccaggccgaggctcatgtggtcgagcccaatcgcggcgcatggctgacacggctggaagaccggacccgggacatggtgcacagccatcggaccggaacgctggcgccgtgggggcagtattgtctgccggcggttctcgcgccgttgtacgcgaccagggaccgcctccgcgtgcttgatttcggaggtgggaccgggacgacctatctggaggtcgccaacgccctgttcggtcccgacgggcgcggcaacctggactatatcgtggttgatgcccccgatgtgtgcgatatcggccggcgccagctgggcgacgcggttcgcttcctgtcgtcactcgacgacgtggcgggagaattcgatctggtccatatgggcagtgtcatgcagtacctgggcgatggctggcgtgatttgctggcgcggctttgtgccatggcgtctccctttatcctgttttcggatctggtggcgggtccgatccgcagcttcgtcacgttgcagacattttatggcgggtctcaggcgtcgcgcttttataatctcggggaaatcgagggggccatgtcgtgccaaggcttcgctaaggtcatggacgtgccttaccgcgggtcctatctgggcaaggcctctcccattcccatggacaaccttcccgcggaaaaccgtctgacggacagtcggcacgcgcttttcatgcggcggggtggaccgaaatccgctccatgagccggcccccggccgggaagggaatttttgtgaacctcgcagttcgggggcgtttctgcgccggctgcggtaccctaatatggctgttgccgacagcttccaatttccaagggacggacgctcagtgacccaatgccgcatctgtgacacgcctatcaaggccttcatgacctttggccgcatgcccatcgccaatggttttctgactccggatcagttcccccaggagcatttcttcgagttggcgccggccttttgccccgagtgcggcatgctgcagatcgtcgagcagccggcccccgagatgatgttccacgagaactacgccttcttctcgggcacgtcgcgctatatgcagatgcacttccagcgcatggccgagcaggtgatggcgacgatccttgctggccgctccgatcccttcgtggtcgaactgggcagcaatgacggcatcatgctcaggaacttcgccgccaagggaattcgccatctgggctgcgagccctcggagaacgtggccgccgtcgcccggtcccagggggtcaacaccctgtgcgccttcttcgggcgcgacaccgcgctgaagatccgggccgagcacggcccggccgacgtgatccaggcggccaatgtcatgtgccatattcccgacctgcagggcgtggccaagggcgtggaggcactgctcaaacccgacggcgtgctgatcttcgaagatccctatctgggcgacgtcatcgaaaagacgtcctacgaccagatctacgacgaacacgtcttcgtcttctcggccatctcggtcaagaacgccttcgctcgtcacggcctggatctggtcaacgtggagccccaggtcacccatggcgggtccatgcgctacaccctggctccgaagggatcgcgccccgtggcctcggcggtcgaggccctgctggccaaggaggtggcacaggggctcgataaggccgccacctacgatcgcttccgcgccaattgcgagacctccaagcgcgaactggtcgccctgctgacccggctcaaaggcgaaggcaagcgggtggtcggctacggcgccacctcgaagagcaccacagtgctcaattacaccgggatcggtcccgatctgatcgagttcatctccgacaccacgcccatcaagcagggcaagctgacgcccggcatgcacattccggtgaagccctacggggactttaccgcccgctatcccgactacgccttgctgttcgcctggaaccacaaggccgagatcatggagaaggaagacgccttcaaggcggccggggggcagtggatcgtctatgtcccctccgtcggagtggtggcgtgatcctgttctccaatcccggtgcccaggtccaggcgcatcgggccgaaatcgatcaggccatcgcccgtgttctcgacagcggctggtatgtgctgggtcgggaggtggaagccttcgaacgggaattcgccgaatatctggggacggcccatgcggtcggcgtcaattccggcaccgacgccctggccctggcccttcgcgccctgggaatcggtcccggcgatcaggtggcggcgccgtcccatacggcggtggccaccatcgccgccatcgagatggtcggtgccgagcccttgctggtggatatcgatccggtccactacaccatggatcccgttgcgctggaggcggctgtcacgccccggaccagggccgtggtgatcgtgcatctttatggtcaggccgccgatatggatgccgttctgggcatcgcccggcgccacggcctcaaggtcgtcgaggattgcgcccaggccaccgggggccgctataaggggcggcgcctgggcaccttgggcgatgttgggtgcttcagcttctaccccaccaagaatctgggtgcggtcggcgacggcggcgcggtggtgaccggctcggaggccgtggcgcagagcctgcggtctttgcgcgaatacggctggcgcggtgaccgcatcagccatgtggccggcgtcaactcccgcctggacgagcttcaggccgcgatcctgcgggccaagctgccccatctggatgccgataatgaccgccgtcgggtcatcgccgggcgctatgatgcggaattgtcctccgtcttgtcgatccctgtccgacggtccgagtcccatcacgtctttcatctttacgtggtccggctggccgatcgcgacgccatggtggcgcggctgcgcggccgggggatcggtgcctcgattcactatgctcaggcggcgcatcagcagcccgcctatgaggcgcgtctggccggcgcgggcaatctgccgcagaccgaacgggccgtggccgagatcatgaccttgcccatctatcccgaactgtccgacgaagaggttggagccgtcatttccgccatccgcacggaattggccggtgcataggatcgtcatctggggtgccggagaccagggccgagtcgacaagccgatcgtggatcggctgggtctgggtctagcggccatggtcgacgatacgcccggactggctccgccgtttcccggggttccgctgctgcagggcttcgacgcgtttctggcctggctggcaacgcagcaggcccatgacctgtccttcgtcatcgccatcggcaatccctacggccatgtgcgcagacatctggcccaaaagctggcggccttgggcctgtcaccgttttccctgatcgatccgacggcaatggtgagtgccggcgtggtgttggggacaggactgcagatgatgccgtttgccctggtgcatgtggatgccgtcgtgggcgatcagtgcatcgtcaatacccgcgccacggtcgagcatgactgcgtcctcgcggacggtgttgaaatcggtccgggcgctaccttgtgcgggcgcgtccatgtggggcgcgacacctggatcggggccggggccacggtgttgcctcgcctcgccatcggtgccaacagcatcgtcggcgcgggcgccgtggtcacccgtgacattcccgataatgtggtggtggcgggcaaccccgccaaagttctaaggccaaacctagtcagggcttccaagcatgtctgaaatctatatgtccggcccctggattaccgagcacgaggaaaagaccgtgctcgacgccatgcgcaacggctggtacgggcccaagcaatattggtatgtcgagaccttcgagcgggaattcgccgcctggcacgaccgcaagttcgccctgatgacccccaactgcacctcggccatccatttgttgctggccggtctgggaatcacggacggcgacgaggtcatcgtccccgactgtacctggatcgcttcggcggcccccatcaagcagttgcgtggcacaacggtgttcggtgacatcagcgagcatgactggtgcctgagccccgagaccatcgccgccaagatcacgcccaggaccaaggccgtgatcgtcgtcgatctgttcggcaacatgcccgactgggacggcattcacgcgctgtgcgcctccaagggcatcaccgtgatcgaggatgcggccgaggctttggggtcgtcctacaagggcgtcaaggccggcaagatgggaatcggctccgtcttcagctttcaccgcaccaagaccattgtgaccggtgagggcggcatgctgctgctggatgacgagaccctgttcaagcggtgcaagctgctgcgcgaccatggtcgcgagcccggggcctggtacaataccgaggtggcctacaaatacatgcccttcaatctccaggcggccctgggctatgcccagttccaacgcatcgatgaattgctggcctataagcggtatctcctgaagggatatcgcgagcgtctgggcgatatcgccgatctttacctcaatcccgaaccggaaggcggcgtcaacggcgtctgggcgccggctctggtgtttgggaagagtcacggcatgaccaaggctcgcgccatggaggaattgaccgccatgaagatgccggtgcgcccgttctattggccgctgtcctctctgccggcctatggcagcaaggcgtcggaatacgcaccgctcaatcccgtcgcctacgacctgtcggaacgggcgatcaacctgcccgcggcctttagtgtcgatgacgagcaactcgacacctattgcaactgcatccggcggattctcgggcgatgaccgttgcggacatccagctgcagtcgattcattcggttgtcgacgacaacgggacgctggtggtggccgaggtcgggcgccaggttcccttcgagattgccaggatcttcagcatcagcggggttgggcgcggcgaggaccgcggccatcatgcccacaagaagctgtcccagatgatgatctgtctttccggggcggtcgaggtcacggtcgatgacggcaaggggcgccacgccctgaccctggatcatccggccaaggccctgctggtaccgcccggcatctgggcggagcagacctatggagggccggaagccgtcctgctggttctgtgcgaccgggtgtacgaggaggacgactacattcgggactataacgatttcatcacctaccgttcgttggcaggacaggcaaaatgaaaatcatcgtcgccggtgcgttgggccatatcggctcgggcctcattcgaggtctccccagccactttcccggtcttgaaatcgtcatggtcgacaacctgtcgacccagcgctatgcctcgctgttcgacttgccgacgtcgggacggtaccgctttgtggaaggcgacgttgccaccatggatttggtgcctttgatcgccggggccgacgcggtggtgcaactggccgccatgaccgacgcagcgggcagtttcgaccgcaaggacgagctggaaatcaacaatttccacgccaccaagaccatcgccgaggcctgcctgaaggcgggcgtgcctctgattcacccttcctccaccagtgtctacggcactcagaacgaggtggtggacgaggattgcggccccgacgagctggcgccgcaaagtccctatgccgattgcaagctgaaggaagaggctctgctggccgagatgggcaagagtggtctcaggttcgtcacctgtcggttcggcaccatcttcggcacctcgcccggcatgcgctttcataccgcggtcaacaagttctgctggcaggcggtcatgggtcagaagctgaccgtgtggtctaccgcctacgaccagaagcgcccttatctcgatctggccgattgcatccgcgccgtcgctcatatcatcggcaagggcctgttcgacgggcgaatccacaatgtgctgaccgccaattgcacggtgcgccagatcgtcgacgccattcgggtgcatgtgcccgacctggaggtgggcttcgtcgatgcccgcatcatgaaccagctcagctatgaggtggccaaccagcgcttccgcgactccggcttccagttcacgggttcggtcgccaaaggcatcgaggatacaattcgccaactgtccggggccggagggcgcagcctggcatgaggcccctccccgaccagcccctgatcagcgtcctcatcgatacctattaccgtccggccatgctgcgccatgcggtcgaggccatccgcgggcaaacctatgccgatctggacatcgtcctgatcgacaacggctcgaccccggagaccaaggcggtcctggcggagctggaggcggccgattcccgcatcaggctggtgcgctttaccgagaaccagttcagttgggacgacccccatgtgatcgtccgtgaatgctacaacgccggtctggccgcggccaaaggtgatctggtgttccatcaggccgatgacgattggctggcacctgatttcttcgagcggatggtggcgctgtttcgcgagaatccagcctgcaccacggcgatcggggtctccgtgggcgttcgtcccgacggaagtgaggtgtcggcggcggccgccaatcagcgcccgcgtttcatgcccggccacgaaatggccctggcggtcatcgatggcaagccggtcttcggcagtcctggattttgcttcgtcatgcggcgcgacgtcctggaggcggcgggcggctttcacgatagcttcgaacagcacatgctttacggaatcgtcgccttcggcgtgaccggcttcgattccgaagcccgcatgtattggggctatcatgagggtcaattgaacaaggcgttgcgggatcggggttgggtttcgctgggctacactcggagcctgctggatggcttcggtctggaacgccgctgggccgaggccttcgggccggcggcggcgcgcacggtagctgaatttatcgagcggcaggcttaccagtcggctgcggaaattttcgcgggctgcctcgctgagttgcgcccggcggcgatctggcggtcgttcagggctgccgctccccatcttggcttttggaaggcattgccggccgagctgtgggagcaaaagcgcctgttcgccgccaatctgctgaaacttgtcggtttgaagccgctattgaatcgcctgcgtgggcggggagtgtaaggcacacatgagcgagcagagcttgaagaacacgtggcgtgtcctggtgaccggcggtgccggcttcatcggatcggccctggtgggtcaattattggcatccggacactcggtgcttacgttcgacaagctgacctatgccggccatctggccaatctcgacggctggttggaccatcccaaccattccttcgtgcagggcgacatcgccgaacgcgcacaggtcgaggccgtggtcgagcagttccagcccaccaccatcatgcatctggcggcggaatcccatgtggaccgttccatcgccagcgcgggtgagttcgtccgcaccaacgtcatcgggaccttcaccatgctggaggcggcggcggcccatcgggcgcggctcgacggcgcggcgcgggagcggttccgttttctgcacgtctccaccgatgaggtgttcggcagcctggggcccgacgaggccttcgacgagaattcccgctatcagcccaactcaccctattccgccaccaaggcggcttccgaccatctggcacgggcctggagccacacctacggcttgcccgtgctggtgtccaactgctccaacaattacggtccgcgacagtttccggaaaagcttatccccctgatgattctcaatgcggtcgagggtaagccgttgccggtctatggcgacgggtgtcaggtccgcgactggctgcatgtggaagatcatgcgcgggccctggccaccatcgtcgagcgcgggcgccccggcgaagtctattgtgtcggcggagaatcggagcgcaccaacatggaggtcgtgcatacactgtgcgcccttctcgacggtcttcgtccccgcgccgagggccggtctcatgccgaactgatccggcacgtgaccgaccggccgggccatgaccgccgctatgccatgaatatcgccaggattagggcagagctggactggaagccgcgggaaaccttcgagagcggtctggccaaaaccgttgaatggtacctggccaatggggcctggtgcgccaaggtggtcgcagatgccgcctcccgcctcccccgcgatctggcccgcaagaccgatggcaccttgttcgaacgaaaggcttccgcgtgacccgactccccaccaaaggcatcgttctggccggcggcaccggcacccggctgcatccgctgaccctggtcaccaacaagcatctgctgccggtcttcgacaagccgatgatctactatccccttaccaccctgatgctgggcggtatccgggatatcctgatcatctcgacgccggacgacctgccgcgtttcgagcgcctgctgggcgacggccgccgctggggcatcaatctcagctatgcggaacagcccaagccggccgggctgcctcaggcctttctgatcggcgaggagttcatcggtggtgcgcgcgtcggcctgatgctgggcgacaacatcttctacggccacggcttgccgcccctggtgcagcaggcggccgagggtaccggggcgacagttttcgcccatacggtccgtgatcccgagcgtttcggggtggtgaccttcgatgcgtccggcaaggccatttccattgaggaaaagcccaaggcgcccaagtccaattgggcggtaaccgggctttacttctatgacgccgatgtgtgccaagtcgccgccacgctgaagccgtcggctcggggcgagctggagatcagccacctcaacagtctttacctggagcgcggcgggctttcggtcgaactgctgggccgtggcatcagctggctcgacgtgggcacgcccgaggcgctggccactgccggccagttcgtccacacgatccagagcttgcagggcacgggtgtcgcctgccccgaggaagtcgcctatcgcatgggcttcatcgatcgccaggctctggccgatctgatcctgcccatagcgacgtcacaatacgggcgctatctccagggtcttctcgaccacgttggtgctttgtgagcggccttcggcgcatctttttcctgcttgatgttcaggcgcggcggcaattcgccctgctggccgtcatgaccctgatcggggccatgttcgaggtggccggggtgggcttggtctttccgttcatcaagattattacggatccggactggatctcgggctttagttggatggcggcggtttcccgctggctgggaccgctagagcaccgtgatgtcatgctggcggcggggctggggctgatcgccctcttcctggtgaagaacgcctatcttttgttcttctacatcgttcaatataccatttgttatggcaacgtggcccgctacggcgccagattgctcgcccactatatggcggcaccctattccatgcatctggagcgcaactcggcggaaatgatccgtaacgtcagagagttgccgcaagaactgtttaatgcggtggtggctgttctcagcctgaccaccgagacgctggtggtcactctcatcgggggtgtcctgctggctgccgagccattggcaacagcggtggcggcggcattgctgatcgccgtgaccggcatcttttatgccatagccggccgattgctgcgccgatggggtgccgagcggatgcagcgtggcatcagcgtgcagttgtcggtccaggaagcgctctacggcatcaaggacagccgggtactggggcgcgagagattcttcgccgaccgctatgcccggcaaggccgccaactggcgcagctgcaacgattgatccaggccgtttcacaggtgccgcgtctctcggtggaagtgtccatgatgatcggcatgatcgtcctgatcttgatcatggcatggcgggatggcggatcgctggatctgctgcccaaactgggagtgttcgccgcggcggcatttcggctgatgccctcggtcaaccgcatgactctggctctgaccgagttcaaggtgagcaccgctccgcttgaagccttgatccgcgatatgcccaatgggccaagctcggctccggcggaggctcccaatgcgcggcccgctttgacggatgcgctggagttgaggggggtcagcttctgctatcctgatgcccagggggcggccgtcgccggggtcgacctgcatatccgcaagggcgataccatcggtctggtcggaccgtcgggtgcggggaaaagcacactggtcgatatcattctgggcctgctggtgccctcggaaggtcagatcctgctggacggcaaggagattcagacgggtggtggctggcacggggcagtgggctatgtgccgcagagcatttacatcaccgacgatacggtgcgccgcaatgtggccttcggtgtcgacgacgcacagatcgacgatcgggcggtgcgcagggctctgacccaggcccgcctggatgagttcatcgacgggctgcctgaagggttggacaccaggctggccgaggatggcatccgcctgtccggcggccagcgccagcggatcggcattgcccgggctctgtaccacgatccggatcttctggtgctcgatgaggcgacgtcggcgctcgatcccatcaccgagcgtgaaatcagcgccgccgttgaagccttgcatcggagcaaaactgtcatcatcatcgcccaccggctcagtacggtccgccactgcgaccgtctgctgatgattgatcgcggccgcatcgcagacagcgggacctttaacgagcttcatgccaggaacggtgattttcagaaattggtcgcggctttggcgctgaccactccgacctcataggaattgcccaacgtgacgaacgcctctcccccgcttcactgtctcgttaccggtggtgccggttttatcggcagccatcttgtcgatcgcctattggccgatgggcaccgggtttcggtcatcgataatttcgccaatgggcgagaggaaaatctggccgacgccaaggcgtcggcaccggacaggctcacggttcaccgggccgacgtggcggatgccgatattatccggccgatgttcgccggggtggactgggtctttcatctggccgccatggccgatatcgtgccgtcgatccaggatcccatgctttaccaccgggccaatgtggacggcaccatcgcggtgctggaggcggcccgcgccgccggggtgaagcgtttcgtctacaccgcctcgtcgtcgtgctacggcattcccgagacttacccaacgcccgagaccgcggcgccctcgcccatgtatccctacgccctgaccaagtgggtcggcgagcagtacgtgatgcactgggcgcagacctacgacctggctgcggtgtcgctgcggctgttcaacgtctacggaccccgccatcggacggctgggacctatggcgcaatgttcggggtatttctggctcaaaggctggcggggaagccctacaccgtggtgggtgacggcagccagacccgtgattttaccttcgtcgccgacgtggccgacgccttcgtcacagcggcgaattcaaagatcagtggcgagattttcaacgtggggtccgacgggacgtacagcgtgaaccggatcatcgagattctggggggcgataagcttcatatccccaagcggccgggcgagcccgattgcacttgggcggacatcgccaagatcaaacgggtcctgggatggaagcccaaggtctccctggaggaaggggtggggattctgctgggtcatattgatggttggcgagatgccccggtgtggacacccgagaccatcggcgaggcgacccgcgactggttcaagtatttgggcaaagacgccaacggctgatagatagagattacccacatgagtaatgaaacttcatccccgtcgcctgccgctcgcgacaaggtgcagtccattgagtccctggcggagcgggctgaaaaggcgcgcgaggcgggaaagaccgtggttctgtgccacggcgttttcgatctggttcacctggggcacgtccggcacgtggaggcggcgcggcgggaaggcgacatcctgttcgtcaccctgacggcagaccgcttcgtcaacaagggacctggccgccctatcttttccgagaatatgcgggcggagatgctggcggccctcgcttgcgttgacggtgtgggcgtcaaccatggctccagcgccgaaagcgtgctggacgccatcaagcccgacatttatgtcaagggcagcgattacgagaaccccgacgaagacattacaggcaagatcaactcggagcgcgaggcggtcgagcgccacgggggaagggtggtattcaccaaggacatcaccttcagttcgtcctcgctgatcaatcgttatcttgacgtctacgacccgcctttgcgcgactgcctcaattccctcagagagcgcgatgccctgaacgatattctcgagctgatcgagaagatcaaggatatgaaggtcctgctggtgggtgacaccatcatggacgaatatcagttcgtgacgccgcaggggaaggcgcagaaggaaaatatcatcgcgacgctgtttcgggggcgcgaggaatatgccggcggtgtgatcgccgccgccaaccatgtggcgagcttttgccgcgaggtcgagattatcaccggtctcggtggcgagaccgatgacgaggcattcatcagatcgcatctgcgcgacaacgtccgcctgactacggtttccatgcccggacggccgacgacccgcaagacgcgctatgttgagccaagccacacgcgaaaaatgtttgaagtctacgtgatggacgatgctccgttggcggcggcacaggtcaaggtgctggatcagctcattgccgaccgtgccccggaattcgatgtggtcatcgtcaccgatttcggccacggcctcgtcggaccgtccactatcgacgtcttggtcaagcattcccgctttctagccgtcaatgcacagaccaacagcggcaatttcggcttcaatatgatcacgaagtatccgaaggccgattatgtttgcatcgatgctcccgaggcccggctggcggtcggcgacaagttctccgatattcgcgacgtggtgggtacgatgctgcccaagcggatcgaatgtccccggatgatcgtcacccatggcgggcacggctgttacacctatgactgcgccaccgaaatgcaccgtattcccgccttcaccaagcaggtggtggatacggtgggtgccggcgacgcctttctggcggtgaccagtccgctggtggcggccggtggctccatggagcacgtgggctttatcggcaacgctgcgggggccatgaaggtgggtatcgtcggccatcgcaaatcggtggaaaaagtgccactggtgaagttcgtcaccgccctgttgaagtgatcttcgaggaagaccaaagaatgactcagacctggaacgtattggtgaccggcggagccggctatgtgggcagcgccctggtgcccaagctgctggccgagggtcacaaggtcaccgtcctagacctttatctctacggcgaggatctgttcgccgatctgcgcgggcccaatctgcgcgaggtcaagggcgacatccgcgacatcaaggtggtcgaagatgccttgaagggctgtgactgcgtcattcatctggcctgcatctccaacgacccgtcctacgatctcgaccccaatctgggccgcagcatcaactacgaggcgttccgccccatggtgcgggccgccaaggcggcgggcgtgaagcggttcatctatgcctcgtcgtcctcggtctacggggtcaaggacgagccggaggtcaccgaggacctgccgctggagcccctgaccgattactccaagttcaaggccctgtgcgagcaggagctggaggccgagcgcgagcccggcttcgccgtgtgcaccatccgcccctcgacggtgtgcggctatgccaagcgccagcgtctggacgtggtggtcaacatcttcaccaatcaggcggtcaacaacggcaagatccgcgtcaccggcggcccgcagaagcgccccaacatccatatcgacgacatggtgcgctgctacctgcacctgctgcagcagccggccgagaagatcgacggcaagatctggaatgccggcgacaccaactttcccatttccgaactggcggaaatcgtccgaaaggtggtggggcaggttgagatcgagaccctgccgaccaacgatccccgctcctaccatgtgtcgggcaagaagatccgcgacgagatcggcttcgaactgcaatacaccatcgaagacgcggttcgcggtctggtggatgccatgaagagcggcaagctgatcgatcccctcaacaaccccatgtacttcaacatcaagcgcatgcagcaggtgagcctgaaataggggccgcacggtgctgatcggcgttgatttcgataataccctggccggctacgaccacgttttcgtggccgctgccggggagcgcggatggttgccgcctggattcgcaggcggcaagcgggaggttcgcgacgcggtccggggcttggtggatggcgagcgcaggtggatggaactgcagggcgaggtctacgggccccgcatgcccgaggcggaactgatcgacggcgccgaccgcttcctgacccgttgcaggtcagaagggatgacggtcgtggtggtcagccacaagaccgagtttggccatttcgatcccacccgtaccagactgcacgatgccgcccgcgcctggatgacggccaaaggcttcttcgaccaggcagctttcgccgtgagcgaagcgttcttcgaacccacccgcgagggcaagatcgcccgtatcaaggccctgggctgcgacgtcttcatcgacgatctggaggaggtgttcctggcccctggctttcccgccgcctgccgccgcctgcatctggccggggcggccgccggccgttgccacgggccctttgccagttatcccggttgggccgaaattcatgacgccgtcttccccgccgcctgaggacaccgccgcgctggcggccctggtggcgagcctgacggggcttgcggtatccggtgtggcgcgaggcggccagggcggcaataaccggttgtaccgcgccgagacgacggccggtcccttggcggttaaatgctatttccgccacccgggcgatacgcgcgaccggcttgccgccgagttcgctgctcttcgctttctgggggaatgcggtgtttccaatgtgcccggggccatcgccgccgatgcgcaagcgggcgtggcgatctacgactggatcgatggtcagccgccagtgacccggcaaccgggcgacatggcacaattggcgggtttcgttgcggtcttgcgggaccttgcctctcgaccggcggcgaccgccctgcctctggcctccgaggcctgcctgtcggcggaggaactggcatgccagctggagaagcgtcttgctcgcctgaacagcggtgccggcgaggtcgattcccaggtggcatcctttctggacgagctgctcggaccggccgtaatgtcggcggtctcggcggcacggggacagtatggtcggcttggctgggactttggcgccgatctggctttcgagcggcagtgtctcagcccttccgacttcggaacgcacaatgccctgcgtcgcgcggatggctccctggtctttctggatttcgagtacttcggctgggatgacccggtcaagctgacggccgatactctcctccacccggggatggagttaagcgaagccgagcgggcggagttcaaggcggccaccctggctatccatgggggtgatggcggctttgccggtcggttgaatattttgctgccgctttatgcgttgcgctgggccttgatcgtcctcaatccattcctgcccgagcgttgggcccggctgtccttcgccactggggcggagcgggaaacggtgttgcgggtacagctggccaaggcgaggcggtttgtcgccatggcgaccggtggcttggacattgacgcgaaagccgcgttcatactatgaacccccttcacttatgcggagcccaaccatgactcatgcggtccccttgccggccctcgacgaacgctccatgcgtttgcgccggctggtgatccaggcgctggacggtggtggtcgtggccatctcggctcgtccctgtcgctgatcgagatcgtgcgggtgctttacgatgaggtgatgaaccatcgccccgccgagccccgttgggagggtcgtgaccgtttcatcctgtccaagggtcacggctgtctggcgctttatgcgattctggcggacaagggctatttccccgaggccgagttggcgcgcttctgccgcaatggcagctatctgggcggccatcccgaggctggcaagattcccggcgtcgaggcatccaccggggcgctgggccatggcttgtccatcggtgtcggcatggctctcggcctgcgcatcaaggcctccgccgctcgggtgttcgtcgccatgggcgatggcgagatcaacgagggctcggtctgggaggcggccatggcggctggcaagcaccggctggccaaccttaccgccctggtggactacaacaaaatccagtcttatggcttcgtctcagaggttcagccgctggaacccctggccgacaaatggcgcgccttcggctttgccgtcgaggaaatcgacggtcatgatgttgcggcactgcacggcgcgctgtcgtctcccgacgcggagagccgcccaaaggcggtgatctgccacacggtcaaggggcgcggcgtgccgttcgccgagaacgatcccaagtggcaccataaatccaatatccccgctcccgagatcgccgccatgtatgccgcgctggagaccatctgatgcgcaagacatccctggacatggttcatgagctggcccgccgcgacaagcgggtggtatttgtcggctccgacctcggcgtcggcaccctcaacgccatgaagaaggagatgcccgagcgcttcttcatggaaggcgtggccgagcagaatatcatcggcatggccgccggcttggccatggaggggttcatcccctacgtcaacaccattgccaccttcctgacccgccgctgtttcgagcaggtggcggtggatctgtgtctgcacaagctgccggtccgcctgttggccagcggcgggggcatggtttacgccccccttgggccgacccatctggccatcgaggacatggccatcatgcgggccctgcccaatatgacggtggttgccccctccgatgccgaggaaatgaagcgggtcatggcggcgtcgctggacctgccgggtcccatgtatgtgcgcttcggcaagggcggcgatccggtggtgccccagacggaattcaccctgggtcgggccgcctggatccggcccaaggccgaggtgattctggtctccaccggcgtaatgaccgagcgttgcgtgcgggccgccgatctcctgaaggccgccggaatcgtctgcggcgtgctgcacatgccgacggtcaagcccctggatgcccaggcggttcttgaggccgcccgggccgctaagctgctggtgacggtggaggagcatgtggtcaatggcggactgggaaccgccgtggccgaggtgctgatcgatgccggcggggtcctgccggcagtcaggcgcctgggtctggccgatgccttcaccaagaattatgggtcccaggacgatctgctggccgaggcgggattacagccggaacaactggccgataccgtcaaggcggcactggggcggtgatgagccggcagcgggccgagtttgcgacgcaggccgacctggcgctcggcgagcgctttctggccgaagggcatgtggtgctgccggtagaggattcggcggccctggaccggctgcgggtgcgggtggcgcaactggccgccgcccatctcggccagccggagccggccgacatcaccgtgtttctggagaccactcaccaccatgtggatgcccaggggctgaatgccctacgtctggcggtgatcgacggcatcaatgccgagccttgggcccgccccggctatttcgcgactgcccgccgcgccatcgagagtctggtgggcaacgaactggccatgcagttgcggctgaacctgtcgatccagctgcccggcgattcgtcgtctctgctgccggttcacgccgatgtgtggaatggtgactcgccctacgaggtggtgttgtggctgccgctggtgaattgccgtggcagcatgagtatgttcctgttgccgcccgaggccgatgcccgccatgcttcccgcatggccgagcatccgtcggccgaggacctgttccgcgccatcgagccggatctgaaatggctgaaaatggagtacggccaggccttgctgttctcccagaacctgatgcacggcaatcgcgttaataccgagccggcaacccgctggtcgttcaactgccgcttcaaggggttgttcacgccttatgccgacaagcggctgggtgacttcttcgagcccatcaccatgcgcccggccacgcggctcggggctgcctaccggctaccgggggtggatggctgatggcttatcgcggatacatcgccagtcgtccggtcatgggcgagcgcacgccgcagcatgtacagaacctcgtggtgcgcgattatgcccggcggcgcggtctgacattcgcgctgtccgcgaccgaatacgccatgcctggctgctacatgattttggaacaggtgctggacgagatgccccgtctggacggcattatctgtttcagcctgttcatgctgccccatgacgtgtctcgacgggcagagacctggcggcgagtgcgggcggcgggcggatcgctccatttcgcggtggaaggcctggccgtccaatgcgatcaggagttcgaccgggtcgaggacatctggacggcgcggaccgtaatgaaggaatcagaatggcaaccctctacagttcgctgaagtttctgcggttttccgaccggctggaagcgctgcgcagcggcgatgtggcggcgccggttcatatccggatcaagcccaccaaccgttgcaatcataattgctggtactgcgcctatcgcaccgacgaccttaagctgggcgaggacatggacgagggtgattccatccccgaagccaagatgatggaaatcgtcgaggacgtgctggagatgggggtcaaggcggtgaccttctccggcggcggcgagcccctgctgtacaagcctctgcccaatgtgatcgagcggctggcggctggcggcgtcaaggtggccaccctgaccaacggctccaatctcaggggccgggtcggtgaagcgctggcccgccatgccacctgggtacgggtgtcggtggacgcctgggatgatgccagctacatggcatctcggggtgccaaggacggggagttcagccgtctactggaaaatatgcgggccttcgtcgccaccggcactacttgcgtgctgggcgtctcgctgatcgtcggacacgaaaaccaccagcgtatcgccgaaatctgcaagctgttccgcgacgtgggtgtcaatcacgtcaagctgtcggcggcggtggtggccaatgacgttcacgccaacaatctatatcaccgggctctgatggcagccgtgacggcgcagatccatgaggccaaggccctggaaaccccatccttcaaggtcttgaaccactaccacgagaccgaggagcggttcgagaagggctatacttcgtgccccttcctgcagttcctgaccgtcatcggtggcgatcaatgcgtctatacctgccaggacaaggcctataccgccagcggtaagctgggctcgctggtggggcggcggttcaaggacttctggttctcgccggagaaccgggagcggctgcattgcttcgatccgtcgagagagtgccgccaccactgcgtcacccacgccaaaaatctggcgattctggaatatctggcgctcgatcccgatcacggcatgtttgtctgaaggcgattcatggcagagatcaacttcctgacccggtatcaggcggccaccaagcgcgattatgttcagcgagtggtcgatcacgataaggcccaatgcgccgagatcgccaagcaatggggtttcgactattgggatggcgatcgtcgcttcggctatggcggcatgcgctatgacggccgctggcgccccatcgccgaggatatcgcccgccattacggcctgaaggcgggcatgcgcgtcctcgacattggttgcggcaaggctttcctgctttacgaactgacccaggccgtccccggccttgaagtggtgggtctggatatctccgcctacggcatcgccaacgccaaggaggagatgcggccttatctgctcgaaggcaactgcaccagcctaccgttcccggacggccacttcgatttcgtctattccatcaacacgttccataatctgctgaatttcgagctgatggcggcgttgaaggaaatgcaacgggtgggcaagggcgccaagtggctgtgcgtggagagctatcggaacgagcgggaaaaggccaacctgctgtattggcaactgacctgtgagacgttctacacacctgcggaatggcagtggttctgccagatggccggctatgacggcgatagagggtttatctacttcgaatgaccattaatataaatcaggtcgatgggaaattcatcgcgtatcaatgccgaaaaattttaaggggggaaatcacccttaagaaaataaagagcatgatgctgttcgtactttatgtattaagcatcccaatgactctttcaatagtattgattattcgcgcattgcggccatttgtcctgatcagatttggggcgctgcgctctgaccgtattggtcattacgcatcaaacaccgatctatacttatgccagaaaagcaatggtgaaacaccggagaagtcattcgacatatttcattgcagcacattgccggaggcaaacgaggctttgacggtgatttggcggcgctgtctccgaatatggcaatggagcaagattctctatctggcaaatgagctgttacctgggtggaggcttcattgcattgttttgcccgatgatatgtttccggtcgctcaactgcaaagccgtatccctgctcacgcctatttctcgccggatgaaatcagaactgggtggaagcaaattgagagaattggaattcagagggagacgaaattcatttgtctcaatacaagaagtgatgggtttttaaatactacacaaccagatacaaattgggactatcactcatacagaaatactaatagtgaaaccttgctccctgctatatcggcacttgtcgatcgtggctacaaagttgttagaatgggcttgcacgtcggcgatcccctggtctctagaggtgtggtcgactacgcgactagcgaattccggacgccatttctggatttattcctggctgcacattgccacttctttgttggcgatagcgctggtctggtcggagtgccgctgattttccgcaggccaacggtctgcataaacctcattccaatgcgtcatgtctgccgatggctatcatcttccgttgtcgtgcccaaggccttgcggtatgcggcgacaaaagatgctgttcccttagaggaatatatcagaagtggagcattcaattttctcagaacggagaattatgctgctggcggatatgatgttgtcgatgcatcgcccgagatcttgcgcgacgcggtgatcgagatggatgaccgtctggctgggcggtggcaggagacggacgacagaatccagcgacaggcgcgattctgggcgatcatgaatcgtcacctccctgactgtgggcagataacaaatatcgcggatgcatttctagagtccaatccaggactatgctagaatagtgtctttttaagttgagatgatgccaagagtggcgaatgtgaggaatagctcatgattacaaaaaaagaagatgcaactagcgaccgtctggagcatgaacttgatgttctggccggacgttgtgatgtgtctaacctggaagacatgctgcgattcccgaaatactttcagatagagaccacgaggctttgcaacgcccgctgcccattctgcgcgattgatcagtgggacaagtcgacccctttcatgtcggatgaattgttccgcaagatcgccgacgagatcatatcgcagcgtgattggatcaagtttgtagatctgcagcgtgcgggagagccgctgctcgacaaaaagatttatgaacgcgttgcctacatgaaggatggcggggtcaccaatgtcgttctgacgaccaacgcgtcgagtctcacagaacgaaacgctcggcgtttgctggaggcgggaatcgatgagttgatgctctccatcgattctgttcagaaagataaatatgaaaaactgcgcgtcggtttgcccttcgaaaaggtgatggacaacataagagggttcttcgctttgcgagatcagatcaggccgagctgcatggtccgtgtgcgaggcgtttccttccatgatctgtcggacccggaggatgcggccgacctggcgtcgtgggaaagcttttgggagcctctgcgcaagcctcatgaccgcatctacatgaagcgggctcacaattggggaaatcagaagagtgtcgagggccatagcccagaatattcctgggtctatcatccctgcattattccgtggtccaccatgcatattaccgcaatgggaacagtcgggctgtgcccgcaggattatgacgggctggccaacctcgggaacatcaacgaacagtccatcgctgaagtctggaatggcgagaagttcgccgaagtccggcggcttcatgcgaccggcgccaggaatgacatatcattctgtcagggatgcttgttgtttgacgaagaattcaccctggagcgggagcgaaatgttgcctcgtcgcgcgatgggacgctcgaggccttggtaaaaaatgcaaagcgcattgcctgacatggcgcaggccgaggcaaagaaaggccaggaccattttgccacggccacgctgatacgggtcgtggaggaacggcttctgtcgctgtacggtgagggcaggctgcacggcacggtccatacctgtattggacaggaatggaccggggtgtccgtggccagcgccctcagatccggcgattacatcctgtccaaccatcggggacatggccactatttggcctggacggatgacgtggaggggctgattgccgaggtcatgggccgggaaagtggtgtctgccggggccgggggggaagtcagcaccttcgtggccagggcttcttttccaatggcatcatcggcggcatggcccccgttgccgccggcctcgcaatggctcatcgccttgcgggcgacggcggggtggcggtgctgtttatcggagatggcggtcttggccaaggtgcccttttcgaagccctgaatcttgcggcctccttcagcttacccttggttgtgctggttgaggccaacggaatcgcccagtccacaccggtggatacggtgcaggccggaagtgcggtaggtcgcgccagggcatttggcatcgaggccagggagtccgatacctggaatcccgaagacctgctgcgcgcggtttccgccaccgtggatacggccaggcgcgaagggcgtcctttgctccatctggtgcgcacatttcgactgatgccccattccaagggggacgacactcgggcgccggatttgatcgaagagtatcgtctcaaggacccggtgacgcagtggctggccgaaggagggccggacgccgcccgtgttcgggcggcggcagtcgagcgggttgaggccgctgtcgccaaggcggcggcagctcctccgggtcttgtcccgtcaacctcgcccccctgttacgccaagcctgtcaacctcgtccccgttcgggcatgtgagggacgtctggtcgaacatattcgcgccgggctggatgccgccatggccgccgacgatcgtttgctgctcttgggcgaagacatctgctcgccatatggcggtgccttcaaggtcacctccgggctatcggacagctacccggggcgtgtgttcaatactccgatcagcgaggctggcttggtcggtgtcggggcggggctggctcttgccgggcgccgcgtcgtcgcagagataatgttcggagatttcctgacattggtcgccgaccaattgatcaaccacgccgctaaattcacgcagatgtacggcgaggatgtcgaggttcccttgctggtgcgcactcctatgggagggcgccggggctatggcccgacccacagtcagagtcttgagactcatttttttggcgtcccgggtctgacggtcctggccatccatcaccggatggatgccgcagcgttttatgcgcggcttatcgcaacggccaagacgccgcatctcatcatcgaaaacaaggttgcctatggtgtcgattgtgcccgggaccgccttcaggggttcagctatgtcgagaccgacgatgatcttccgacactggtcgtacggccttgcgtccaggcccaagtcaccattctcggttatggtggaatgttgctggagatggaaaaggccatggaccggctgtttgaggatgccgatatcgtgactgaggccatatgtccggtcgccctctatccaagcaacatgcaggcgctcttggactcggtgtcgcttacgcgccggctggtcgtggtcgaggaggggcaaggctacgcgggatacggtgccgaggcggtcgcatttctccaccagcacctgccgggtgggttcagccttcgccgtctctccgccttgccgactgccatcccttgttccagggagggggaggctgcgtgtctcgtatcggccaaggacatcgtcgaagcagtccaggagattctttcgtgacagacttcatcgtcattcgggcgcccaagaattctgccaacgacgaatcggtgatggttgtccgcctgcacgtccaagcgggagaacatgtgcgcgccgggcaaatgctgcttgaggttgagaccagcaaggcggttatcgaaatcgacgctcccgccagcggccgcttcttcccggcggtccaagtgggagatcacgtcccggtaggccgaattcttgggggtgttggccaagattccgagcatttggcggcggccctggcggccgagaatgttccgtccggggaggtgtctgttgccttgcggaccgacggtgtcagattctcgcgcacggcttcggagatgatcgcccgacatgggctcgatcccgattcatttgatggacaggggcttgttaccgcggcgatggtcgccgcagtcctggcacgagccgccgatggcaattcgaagcctcgaagcggccccgtgcggcgcggggagaacggtaaagttgtcctgctgggggccgggcccggcgcctggcaattgctatccgtcctggaacacgagcatggcagtgaagtggtcggcatcctggacgatgatccgctcaagcttggccgggagttgaacggtgtcaaggtgatcggcccgctttccatgctgaccgaactggcggaacaggggcgggctgattcggcgatctgcacgacgccgacctccatcccatttcgcgccaaggcgcatcagctgaccaaggccgccggattgcgtggcgccaatatcattcaccccagcgcccttttcgatatcgacgtggcgatcggggaaggcaatttcatcggcgcgttcagctatatcggcgccgggacggtcttgggcgactactgcttcctcagttcgaggaccacgtttgaacatcacaatacccttggaaacggcattaccaccgggccgggagtgtcgacctccggattggtgacggtgggcaatcatgtccgctttggtggtcatatcctggtcgaacccaatgtcaccattggcaatgacgtcgtgattgcgtcaggaatgaccgtcaccgctgacgtcgaagccaacagcgttcttcgccagcgagttgccacccgctgatccgtgcttggcgccaaggtaaaatatacctttcagatgttatattgcataactgagatggtttgtttgttgctgttgttgtgacatgcaaatcaaatgctgtatgagagaaatgacgaacatgactccgcctaccgttccctacttagatcttcgtgtcaccgatgatgccgagcgtgaagatttgctggctgccgtggatcgcgtgctacgccatggacgaatcgtcctgggtccggaagtggcggaattcgaggccaggattgccgcgcgggtggggcgtcgctttgccgttggggtgaattctggtaccgacgcgctgatcctggcgttgcgtgccctgggcatcggtgccggcgacgaggtgattgttccggccctgtcgttcgtggcctccgccaacatcgtcaagctggccggagcggttccggtatttgccgatcttggtcccgatatgaacatggatccggcggtgatcgagggtttgatcaccccggccaccagggccatcctgccggttcacttcgccggcaagatctgccgcatggaggaaatttgcgcgattgccgagcgccatcgcctgctggttatcgaggacgccgctcaggctttcgatgctgtgcgtcatggccgcaaggcgggctcgttcggccaagtgggctgcttctccatgaattgcatgaaagtcctggcgtctcttggagaagcgggtgtcatcgtgaccgacgacgacgctcttcacgatcatttggtacagctgcgctaccacggcttggtgacaaaggaatcctgtggctttctcagccataacggtcgcctggacaccgtacacgccgccatgctttccgtgcggctggatcgcttcgacgaggtcatgcgtcgccgtcgggataatgccgcttattattccgcccggttggggcatctggtcgacgtgccgcgcgatgatgccgattgccaggacgcctactatatctacgtgattgccaccgaccggcgtgatgcgctgcaggacttcctgaccgccagggggatagaaaccaagcagccgcatattctgatgcccgagcaccctgttcacaaggatgcgcggggattctgggacaacgccgcacgtgtccatcaccgccgtctgagcctgccgatcagcgaaaaactgacggatacgcagcggacttacgtggcagacgccattgttgagttcttcaatatttgagaggcgttcgccatgcctgccgtgatttacaataccgatgatgtcgcgctggtcgggcgtgacatgctcgagacattgaaagccgaggcggtgaacgcgccgctgcgccgctcgcgcttgtgtcttcatcgcacgcccgaggacccgctgcatgagatggtcatcgccttttgccgcgacagctatgtccggcctcaccgccatctgaccaagaccgaatcatttcatgtgatcgagggccgtatcctggtggtgttgtttgacgataatggtcgtgtgacccaccgtattcccatgacgcctcccggaggggacaatccgtttctttaccgggttgccgcgccgatctggcatacattgatcccggaaactgacttcgcggtgatccacgaagtcaccaatggcccgttccgggccgaggatggcgatttcgccccctggtcgccggatgatccagagagttctcaagcctaccgggcgtccctggtctgacggatgagttcaatgccatcgcttaagaaaattctggtcaccggtgcagacggcttcatcggctcgcatctgaccgaagaactggtacggcgcggctacgacgtgcgcgccttcgccctttataattccttcgggtcctggggctggctggacgccgcggaaccggcggtcaggaattcgctcgacgtgttcctgggcgatatccgcgatccccatggggtgcgcaaggccatggagggctgcgacgcggtgctgcatctggcggcgctgatcgccattccctattcctatcactcgcctgccacctatgtggaaaccaacgtcaccgggacgctgaacgtggttcaggcggcgcgcgatctgggggtttcccgggtggtgtgcacctccaccagcgaggtctacggcaccgcccgctacgtgcccatcgacgaggaccatccgctgcaggggcagtctccctactcggccaccaagatcggcgccgaccagatggcgttgtcctaccaccgctcgttcgccacgccggtcacggtgctgcggccgttcaacacctacggaccccgccagtcggcccgcgccgtcatccccaccatcatcacccagatcgcggcgggggcccggacgcttaaactgggggccctgcatcccacccgcgacttctcctatgtggccgatacggccgcgggtttcatcgccatgctgaatgccccggaaacggtgctgggcgaggtgatcaatatcggctcgggcttcgagatttccatcggcgacaccgcgcggctgatcgccgaggtcatgggcgcccaggtggacatcacttgtgacgaccagcgcctgcggccggaaaagagcgaggtggaacgcctgttcgccggcacggacaaggccgcccgtctgctgggttggcaaccggcccatggcggactggaaggctttcgccgcggactggccgaaaccgtgcgctggttctccgatccggccaatctggcccgctaccgggccgaccgctacaccatctgagcaccgggggattttccgtgattccactttgcgttcccaatctgacgggcaacgaggcccgctatcttcaggaatgcgtggacagcaccttcgtgtcttccgtcggccccttcgttgaccggttggaggacatggtggccgctgccgccgggtcctcgctgcgcgccgtggccacttcggcgggaaccaccggcctgcacgccgccctcaccgccgtgggcgtggggcgcgacgatctggtgatcatgccggccttcaccttcgtggccagcgccaatgccgtggcccattgcggtgccacgccctggctgctggacgtgacggcggaaagttggactctggaccccgccctgcttgaacgggtgctgcaggccgagacggtacgagacggcgatgtcttgcgccatcaggccagcggccggcgggtggcggcggtgctgccggtgcatgtgctcggctgtcccgccgacatggacgccatcctcgccgtcgcccgtgcccacgatctcaaggtggtggccgatgccgccgccgccctggggtcgcgctatcgcggccgccctatcgcccagttgggtgccgatctctcggtggtgtcgttcaacggcaacaagacggtgaccgccggcggcggcggcgcggtgatcgggacagatccagacctgctggatctggtccgccatctgaccaccacggcgcgggtcggtgccgactatcttcatgaccgggtgggcttcaactaccgcatgaccaatctgcaggcggcggtgggctgcgcgcagctggagcggctggaggaattcgtcgccgccaagcgccgcatccgtgccgcctatgacgccgccttcgccggcaggccgggaatcagtccctttccccagcccctttgggcggaaagcgaatgctggttttccggcttcgtgctggaccgggcggagcgcatggcggccttgcggaccggactgcgcgaaaggggagtggacgcccgcccgttctggcggcccatgcacctgcagccggccttcgccgaggcattgcgcacgcccatgacggtgacggactccgtgtggaaccgcatcgtcaccctgccctgttccacggccctgaccgaggcggaacagcgttcggtggtggccgcggtggaagaggcgctgcgatgaagcggatttgcgtcgtcaccggaacgcgggccgaatacgggccgctgttctgggtgctgaaggaaatcgacgcccatgccgatcttgaactgcagctggtggtcaccggcatgcatctgtctcccgaatacggctccacctggaaaaccatcgaggccgacggctttgccatcgccgccaaggtggagatgctgctgtcgggcgataccggcgtggccatcgccaagtccatggggctgggcaccatcggtttcgccgacgccttcgagcggctgaagcccgacatcgtcgtggtgtggggcgaccggttcgagctgatggcggcggttcaggccgccgtggtggcgcggattcccatcgcccatatcggtggcggcgacgtgaccgagggtgccttcgacgacgccatccgccatgccatcagcaagatggcccatctgcattttcccatcatcgccgattccgcccgccgcctccgtcagctgggggaggaccccgagcggattcacctgaccggcaacgccagcctcgaccatctgcggcgcaccattttcctggagcgggccgaggtggagacgcggctgaatttcagcctgcggccccgcaatgtgctggtgacctatcatccggtgacgctggacccggaggagggccggcgtggctgggccgaaatgctggccgcgctcgagtctttgggggacgaggtgggaatcgtcatgaccgcccccaatgccgacaatgacagccgcgagctgatggtggcgctggaggccttcgtcggggcgcatcccaacgccatccttcggacctccctgggctcgcagctctatatgagtaccgcccggctgtgcgatgcggtggtgggcaattcgtcgagcggcctgctggagatcccgtcgctgggtgtcgccaccgtcaatatcgggacccgccagaagggtcggccgcgcgctgactcggtgatcgactgtccgccggagcgcgcggctatccgcgcggccatggaccgggccatggccatggattgctcggcggtggtcaatccctatggagacggccagtcggcgcggcgcattgttcaggtgctggccggaatcgaggatttccccgcattgctgcacaaaagtttcgtcgacctcgccggacccggcgaggcgggggaggagtaaggccgtgattgaatcgttcaccatcggcagccatcgggtcggtccgggctgtccctgcttcgtgatcgccgaggcgggcgtcaaccataacggtgacctggctctcgcccaccggctggtggacatggcggtgcaggcgggtgccgatgcggtgaagttccagacctttacggcggagaaggtggtgtcggcccaggcacccaaggcggcctatcagaaggtcaccaccggtggcggccagagccagctggacatggtgcggggcttccaattgccgcccgaggccttcgcggagctgtccgagcactgcattcaggccggaattctcttcatgtcgacacccttcgacctggacagcgtggatgttttggaccgcctggacgtccccgccttcaagctgccgtcgggtgaaatcaccaatcccttgctgctgcgccgcgtggccgccaccgggcggccggtgatcctgtccaccggcatgggttccctggtggaggtggcggcggccgtggatatcctggaacgggccggatgccacgatctgatgctgcttcattgcacctcggcctatccggcaccggtggaaagcgccaatctgcgggccatgtccaccctggccgcggccttccaccggccggtgggctattccgaccataccgaggggttcgaggcggccatcgcggccgtggcgctgggggcctgctgtattgaaaagcactttaccctggaccgctcgctgccaggccccgatcatctggcctcggtgtcgcccgccgatctgggcgccctggtggccgtcatccgccgggtggagaagggtctgggcgatggttgcaagcgtccgacggtcgccgaggaagatacccgcgccgtagcccgccgcagcctgttcgccgcccgtgccctggcggcgggggccgtgatgaccgaggaggatctgatcgccctgcggcccggcggcggcatttcccccatgcaggtggacatggtggtggggcggcggctgacccgtgccgtggccgaggggactcttctggaatggagcgatctggcatgagccttgttctttccggcaccggtcccgggctgaccctgtccatcgccgatctgccgctgtggcaaggcgtgcggaaggagccgggcgtgcagcgccgttttcccttccgcctgggtttcgccgggccggggccgatccgccagaccaccgaggccgaggtggtcgccgaggtgttgagatcctatgccggggatgactacgcctttctgaccaagccgccgggcgccagtgcctgggccgacagcctgggcgatgccaaggtggccgcggtcatggagaattggaccggccagccgccgcgggccatcctcgaagtgggggcgggcagcacctatgtgggtgaaaagctactggcccgcttcggcgaggggccgtcctacaccatcgtcgatccggcggtgcgcgaccagggcgggcccatccaggtggtcagcgactatttccccgctccggccctggaggggcgccggttcgacctcatcatcggtttcaactgcctggagcacgtccccgatcccgtcgccgtcctggccgcggcgcgccgacatctggcgccgggcggtctggtgctgatgacctatcccgatactgagcagaatctgaacgagggcgatatcaacgccctgatgcacgagcatctcagctatttcaccgagcgatcctcgcgctgggcggcgcaggccgccggactggcggtccgggggctggagcgccgcgccggagccttcgtggccgtgctggaacatccgcccgagccgctggcccctccccaggatctgtgggaggaggatctgctgcgccgggccgccgagatgctgaattcgctgctgctgcgcaccggcggcgagatcgccgcccgcctggaggcgggggagacggtggcctttcacggcgccaccaacggccttaacagctttctcgccctgaccgggctgggaagccatccggccattcgggtcttcgacggcgacgacagcaaggtgggccagttccttcccgcctgtcccacgccgatcctcggttccggcgatccgtcctatcccggccacgatgccatctatgtctcggcggtgacgttcctgccggccatccgccgcttcgcccaacaggttcacggcctgccggcggaacggctgctgcctttggtgggttgaaccatggcccggaccctgaacacactcaccggcggttttcctcccggcgtcattcctccggtggatctgcacatgcacaccacctggaccgacggctccgccccggtggccgagatgcatgcccgcgccgtggccgagggcctgaagaccatcctgttcagcgagcatgcccgcaagagcagcgccgactggttcccccgcttcgccgccgaggtgcgggccatatcggaccagcattgccgcgccctggtgggggtggagtgcaaggtcgaggatttcgacggcgccatcgacacggtgccggccattctggccgaatgccatctggtgatggccagcgtccaccgttttcccggcgaaagcggcatcaccaccggcaccaccgggcactatacccccgagcaggcggtcgacatcgaattccggctgtccatggcagccatggacaatccggccgtggacattcttggccatcccttcggcatgagtatcgcccgcttcaagacctcgccgccgtgggagctgtttcaggccctggtggacaaggcggcggccaccggggtggcgttcgaggtcaatgcccgttaccaccccgatccctgggcgctgatcgaagcttgccgtaaggccggggctcccctatccctggggtccaacgcccatacccccgacgaagtgggattgatcggccgcttgttgcaaaaggaaatccagtgaagaacatccgtgtattggtgaccggcggcggcagcggtgtcggccagggtatcatcaaggccctgcgaatttcgggattgccggtgacggtggtgtcgggcgacatcgcccctctcaatgccggtctttttctggcggacgaggccacgctgattccgcgggtggaagacgccgatgcgctggagcgctttgtcgtcctgctgtcgcagggcggcttccacatggttatgatcggctctgaattcgatctggcctttttctcacggcaccgcgacaccatcgaggcgcgcaccggctgcaaggtgatggcttcgccgctgtccacggtggagatggccaacgacaagtggctgaccaccgagttcctgcggaccaacggcctgccccacgccgccgcctgcctgcccgcccatgcggacgaggcggccgcctgggcggcggccaacggctatccggtggtgctgaagagccggaccggcacgtcaagccgcaacgtccatatcgttaaggacgaggcggatctgcgccgcctgttttccctggtgcccaacctgatgctgcaggcctttgccggcagcgagggtgacggcctggcccacgaatacacctgcgcggtgttccgggccgccgacggcagtctgctcggccccctgaccgcccggcgcaccttgcgcggcggttcgtcttgggtggtcgaggtgggtgactaccactggctccatcccatgctcctggccatcggggagcgggtccccagcctgggttcgctcaatgtgcagctccgggatggccccgacggtcccatcccctttgaactgaacgcgcgcttttccggcaccacggcggtgcgggcccatttcggcttcaacgagccggccttcgcgctgcgcagctacctgctgggggaaaccctggcgccgcccaggatcgggtccggtctggccctgcgttatcttgaggaggtcttcctcgacggcgttgccgccaccgaactcgatcatgccctgccccggggagtggttcgcgattggacatgatcggagtcaccggtgcatcgggactgatcgggcgccatctgctggcgctgctggctagaaacggccacgcggtgaccgccacctcgcgtcgccgcccggaggcggacgtggcgtggcatccgtcggaattggccgagtggcgccatcccgaccagttggacgggctgttcgctcatgtggatgccgtggtccatctgggggcggccctgccgggggccgatgccgccgccctgatggatgtcaatctccgcgccaccttgatcctcggccaatgggccgcgtcgcggggcaagccgctggtcttcctgtccagcggttccgtctatggcgaaaccggtgggccggtggatgaggacgcacccatgagcgcccagccgttgggcgggctctatggtctgagcaagcaactggccgaacaggcccttgctcaccttgcagcccagggcttgcggcgcaccgtcatccgtcccacggccgtctatggctggggtatgcccgttggcaaactggtggcggcattcctggcgcgggcccgcgccggagatgttctggaggtcgcgcccccagccgccgacagcgtcaatctggtccatgccttcgacgtggcgagggcggtggcggcggccctggagtcggcgcaatacggggtcttcaacgtgaccggcccggcccaggtgtccatgggcgaactggcccgcgcctgcgtgcgggtcgccggatcgggatccgtgcgggaaccggacggcgaggcagggcggccgcctgtcgaccgtttccgactgaagggctcgcgcgcggccgccgctttgggttactcacctcgggtcgggctcgatgagggcctgggcctcatgttgcatcaagcctgcctgcccgaaggggggctcccatgaaacgctggcaagatacgctggtttctcccacgacgccggtcttggacgcgatcaaggcactggatcttggcgccatgcagatcgtgctggtggtcgacgggcaatcccgtctgctcggcaccatcaccgacggagatatccgccgtggccttctgcgcggcctgccgctggagtctcccgccagcgaagtcatgaacccccggttccaccatggtcgggtggaagacgaggccggcgtcctgctggccaccatgcgccgcctgcagatttcccaaatgccgctgctcgacggcgacggccgggtggtcggcctgaagacgttggagcagatgctggctctggacggctgcgacaactgggtggtgctgatggcgggtggcgagggccgtcgtctgcgccctttgactcaggatgttcccaagccgctgcttcccgtggggccgcgccccatcctggagaccattctcaagaacttcatcgaggcgggcttcaggaacttcttcatctcggtgaactaccgggctgaacaggtggagagtcatttcggcgacggctcggcccttggggtctccatccggtatctccgcgaggaccgacagttgggaaccgccggtgccctgggcctgcttcccggcacgccgtcggagccgctgatcgtcatgaacggcgatatcctgaccacggtcgacttcaagcagctcttggccttccaccaggaacaccgcgccgcggccaccatggccgtgcgcgaataccatttcgaagtgccctacggggtcgtcgaggtggaagggacccgcctcaaggggatcgaggaaaagccggttgtgcgcaatttcgtcaatgccggaatctatgtccttaatccagaggtgctgaatctggtcaaaccggggcagccgcacaatatgccgcaaatctaccagactctgatggatggcggtcaggattgcgccgtgtttcccatacgggaatattggctcgacatcggccggctagacgatttcgatcgggccaatctggatttccatgaggtgttccgctgaggaccgcgccgggtgtggatgggacaagcccgggtgcgcccatcaaagccgtctggcgacggagcacccctcgtcgtgtcgttgttgacaaggtcaggtgatgaatattctccttattaccactccgattcgcgtccgcccgacgaattttccgcccatcggtgcgttgtccctgttgaaggcggcccgcaagaacgggttcccctccacccagttctaccatgtggacggcaaccgcccggattacggcgcagtgctggagcacttggaaaaggtgcggccggacgtggtcgggatcagcgcggtcgtctccaccgcctacgcttacaccaagcgcctgtgcggcgacatcaagcgtctgttgcccgacaccctggtggtggtcggcggcaatctcgcggcatcggcggaaattcttctgcgcaaagcgggcgccgatctgtgctgtatcggcgagggcgagcgagttttcgtgaacgtgctgcgtcgcgccgaaaccacgcatcgtccggccgatttccttgacattcccggtctcgccctgctcgacggcaatggtcggctgcggacgaccagctttgaagctccgctcggccgcgatgagatctatgactacgacatcgccgatctggttgcggcctgcgacgacatcgagacctatatcaatcctctgttcattgacgatgagtgtcagtcgtcggaattcaagttcgaccagatggcgtggcagccgcatcgtcgcaacaagaagctggccatcatccccggggctaagggatgtgtcgcccgttgcaccttctgccatcggttcgacaaggggatccgttatatccccgtcgatcggatcatgcgtcagattgaaattctggtgcgtgaccacgatgtgggcttcatttctttcggcgacgagaatttcggcaccgacaagcgctggctggccgaattgtgcgcccggctgaagccgctggatctgctgtggcgggtgggcggcatgcgtgtcaactgcgtgtcgcctgaaatcatcgccatgatgcaagacgccggctgccgcttcatcgcctatgggatggaaaccggcagtccccgcatgttggaggtgatggagaagaagaccaccatcgaagacaaccgcaacgccatccgctggaccatcgaggcgggaatcgccgctccgatccagatcgtcctcggcatgccgggcgagacgtctgaaacggtgcaggagaccatcgagttctgcaaacacggtcagaccttccggccggagcagaaccccaacgatctctccatcaactacgcccaggctcttcccgggactcccctttacgagtttgcgcgctcgcgtgggcatatccccctcgatctcgatggagaggagaggtatctcctgtccatttcggatcacgacgcccacgacgaggtgaccacgctcaatctgaccgactatccggcgctgatctgccaaagctggcggccgcgaatgacggtggaggtcaattacgcctatgtcgccaaattcgggctggagcactatcacaaggtgctcctgaacgacgccaattattttaagaagaagcggcgcgacgacggctatttcgctaatccaaagcgtctggtcgacacctctatgacggtagattccatgcatggttcccgcgacgccatggaagtggaggatgaaaacacgctcccatcactatggggattgctgcggcaaggcaatcttggcctggcgatgatctgttaccctatattgttctatcgcctccgccgactgatccccctgatgattttggccaaaaatgccaaacgggtggggctggattgcgccgtgcggcagcttgccgaaaccatgcggtggctgctgcgtcggaactggcggggcggtcccttcacctataaatctctgcgtaagatcgtcaaggacgatatcggaccgattcccggcgatcgggacggaatggacgttcttcgtcagggccggtaagggcccgggaagatgagcgtggatatgaccggttgtcacgaggtgccctgttgagcgttctggagatatggttcgaacgcatgggcgtcgggcatctggtgttcggattgttgcgatatgggtggcgtgatcgggtgttcgtctcgccggagtggagttcgtccgccgaaagactggcgcaactgattgagcgactgacgggggtggccgtggcgcgtgcccggcgcccgctgcaattcgccggcccggtccagggtggacgagcgttggtttacgggcaggagcgcgagttgctggaggtttcggccgccttcgccgattcctgtccgactccgcccacctggtgttgcgcggaggattttcgccggattctgggggcgtatttcatcaccttcaatcgccactccgtcgctttcgcctgcggtgtcgccgccagtctggagggacgcgccggggtcaaggcgatttgtcatgttgcctttcccgtcgtcgggcgattcgcggcaagccagatgaacacgcgggcatcaccggatttccgggtgagcgcctttccgaccctgtcgggtctgatcgaatgcctgcgctttcttccgggccatccccgccattggttccgtcttttggtcggtcatcgcaatgaggactgcgccgtggatccattcgctcgcgagaacggcgccatcctggaacaggcctcctggccgagcatcaacagtcaccccgacggcggccacctgtattgggagccggccagcgggctggccccggcccaagtggttctgtattgcgaccgctccgacacgctggccgatgagcgcctgcggcgcaaggcggccgacaagggatggggctggattgatggcgccagtattctcgcccatcttgccgatcccggcggggccatcgccgaggcattcacccgggcaaaaagcctgttgccgcgcagaccgaatgtcgtgagttggatgcactgggtgttggccgtctccaacggggtgacctttcgggcctatggcgatctcatgcggcgacacaatgtggccgccattcaccattacgcggatttcggccccgaggccgtgacgctgcgcctggcggccaatcactccaatgccatcgtgatttgggggttgtggtccgtattgccgttcctgatcgcccggcatttctgggcttgcgccgatctgatccttgcgtggggcgcctatgaccgggattactttcctgcggcggggttcgatttcaaggcgatcgcccaggtggggccggtgagttcggacagtatcgccgatggcgatactgccagggccgcggcgctgcgtgccggattgtcgccgacaacacgctttgtcgtcgccgcgttcgatacttctcatcaccctctggcctacaattccgaagcgcaacagctttgcttcatcgaagcactggtcgatctgatcgagcggcatgacgattgggccctgctgctcaagcccaagaagtccggggacgaccgctatggagccgaccttgggcgacgcctgaggattttggcggatcaggggaggtgcctgatcacggaacccagggaaaaagtgggagtcgtcggcctggccgccgatctggtcgtcggctatcccatcaataccgcggcgatactggcaagccttcgcggccgtcccctggttcaactggatttgggcggattggtgcttgggccgttgcgggagtccggcattgccgccggtctggtgcacacgaccgtcgactcgtttcaccaggcggtggagcgggtggctgccggcgattccggtatcggcgatatcggcgtgtggcgctcgttgatcgacgcattcggcgacggcgagggaccgctgcgggccgggaggctgatcggcgactatatccgcctgagagtcgaacacggccacgacaaggccctggccctggccgtggagcggtatgcggagagggagggaagccaccgggtctgccgcccggacgctgtcgtcgaggggctgtgggaagccgagcgtcggcaatatcggcaggtggcaggggaggcgcgctgatgtccaaccggattcttgccctgatctgcgcccgtggcggttccaaggggttgccgggcaagaatgtgcggcccctggccgggcgtcccgtcatcgcctggtcggtggaggctgccctgggatcgtccctgatcgatcgtgtggtggtcagcaccgacgatcccgccattgccgaagtcgcccgtgctgccggggccgaggtgccgtttctccggccggcggagctggcgtccgacacggccagtctctacgacgtgatctttcacgccctggaagccttggacgaggagcccagccatgtggtgctgctgcaggctacgtcgccgttgcgcatcgccgccgacatcgacggctgtatccggttatgcctggaccatggcgctccggctgccgcctccctgtgcgagcccggaaaaagcccatattggatgttcctcctggaccccgacgggaccgttcggccggtgatcccccacgacgcgtcgggcggccgtcgtcaggatcttcccgtggcctgggcgcctaacggtgccgtctacgtcgccgagaccgcctggctgcggcgcgagaggaacttctggaaagcgggcgtcacactaggttatgtcatgcctctggaacgctcggtcgacatcgacagcctattggatttccgcgtggccgaaatgttgatgagtgatcgtttggggcctaaggccggctgatccacgcatcacaccagggtccggccgacccgacgcttgcccttggcggctccatgcgccaccctctcccggcggcggcacatcgtctaaaacaggatgttttccccatgtacgatatccggttcttccgtgcctccaaagagatcaaggacgacatcgtcgccggccgctactcggccaaggacgcccccgctctcgccgcacggctggacgcggtccgtgatccgaagccctttgtcttcaacatggagaccaccaattactgcaacatgacctgcgtcatgtgcccgcgcaccaccctgatggaccgcaagaacatctggatcgacgatgcggtgttcgagacggtgctcgatcaggtccgcacccattcccagacggagatcgaggatttctggaagtatatcgagacgacctatcacgtctcgtaccagcagcccgacgagaacgccttctatttctatgtggtatcgcgctgcctgatcctgcacggctatggcgagcctctgctggacaagaagattgtcgaccgggtgcgctcgtgctcgagccgcaacatccccacctatttctcctgcgttccggccaatctgaccgtggagcgcgcccgggaggtgatggaggccgggttgtccgtgctgaaattctccatggacggcctgtccgacgagatgcagaagcgtgtgcgcggcaagcgcaacaacttcgacgaatcgtttcagaccatcctggacatcatcgaactgaagcgcgagaagggctatcagaccctgctggttcccaccatgatcgccctgtccgaggatgacgaggccaaggccatgcaccaggaattcctgaagctgtgggaaggccgcccggtcttcgcctatgtgaagagccaggacaatcgctggtaccacgaagaggaccaggacctgtccaaccgttcgcactaccagagccagtattgcgaatacccgtggacctcgctcaccgtcatggccgatggctcggtggtgccctgcacccaggactacaatgtggaaatggtgctgggcaatgtgcgcgagcagagcctggaagagatctggaacggcaagccttatgccgatctgcggcgctggcacgtggagggcaccttccccgacggccataaatgttccggccgctgcgaccagaagaaagtttgcgggtatctgaaggcatgagcggattggacggaaaagtcgttgccgtcgtcggcggcctgggcctgatcgggcgaggcctggtggagggaatcgctgctgccggcgcgcgcgtggtggtggccagccgcagtgccgcagcgcccggcgccctggcggttttcgaccatttgcccgaggagcaccgggtgcgcatccacgcggtggcggtggatgtctgcgacccggcctcggtggaggccatgctgtcggccgttgccgggcaatggtcccggttggacgggctggtcaactgcgcctatccccagcaggacgccttcggcacccgcttcgaggatgtggactacaccaccttccgcgacaacgtgtcgcgccatctgggcgccttcttcctggtcagccagaaggtgctggctctgttcgcggcccagggcggcggcaatctggtgcaattctcctcggtctacgggatgatgaacccgcgtttcgacatctatgacggcacggccatgaccaaggagatcgaatacagcgtcgccaaggcggggctgattcacatgacctcgtatctggccaagtacttcaaggggaagggaatccgggtgaactgcatcagccccggcggagtgttcaacaaccaggaccccgcttttctggcgcgctacaacgcccattgcaacgccaagggcatgatggatcccgccgatctggtcggggccgcagtgttcttgctgtccgatgcctccgccatggttaatggccagaacatcgtcgtcgacgacggattctcgctatgagccgggccgtcgccatcattcccgcccggggtggttccaagggtatcctgcgcaagaacctgcgtgaagtgggcggcgcgccgctggtggtccacaccatccgccaggccctggagtcaagttcggtcgaccgggtctatgtcagcaccgacgatacggaaatccgcgacgtgtcccaggccgccggcgctcatgtcatccaccggcccgtcgacatttccggcgatacgatcagttccgaggcggtgatccaccacgctctgccggtgatgcgccaggagggcgacttcgatctggtggtgttcctgcaggccacagctccgctgcgggccaagggcgatatcgacggcgcggtggcgaccctggtgcgcgaggaggccgattccctgctgtcggtgtcgcgctcccaccgctttctctggcgccagggcacccagggacccgaagccatcaattacgatcccgcccaccgcccccgccgccaggacctggaagcccagttcgtggagaacggctcgatctacgtgttcaagccgtgggtgctggaacgctatgacaatcgcctgggcgggcgcatcgccctttacgagatgaccgccagcgcggccttcgacatcgacgacgaaatcgacctggcggtcatcgacctgctgatgacccgccgctttggatgagccgatccacatgatcatcgacaagaatatcgccaagtatctggtcttttccgaagacacgcttaagaacgcgctggtgaagatcaacgacaacaaggaacgtgtggttttcgccgtggacgagaccgggcggcttgagggcgtgctgaccgacggcgacgtgcgccgctggctggtcgccgccgatccggtggatctcggcatcgcggcgggcaaggtggccaacggcgacttccgctctgcccgtctgggcggagaccgccacgccatcgaagccatgctggattcccgaatcaatttcgtgcccctggtggacgattatggccatctggtgggcgtggcccgcgcccggcgtccggtcatggatatcggcggcttccggctggaggagagttcgccggccttcgtcatcgccgagatcggcaacaaccaccagggcagcctggacatggccatgcgtctgatcgacgaggcggccggtgccggggcccattgcgccaagttccagatgcgcgatctggccagcctgtatgccaatgccggtgaccataccgatgcgtccgaggatttgggctcgcaatacaccctggacctgctgtcgcgcttttcgctgaagaccgaggacctgttcaaggccttcgaccattgcaaggtcaaggggctgattccgctgtgcacgccgtgggacctggcaagcgtcgaggcgctggagcgctacggcatcgccgcctataaggcggcctcggccgacctgaccaatcaccagctgctggccgccatcgccgacaccgggcggccgctgctgctgtccaccggcatgtcggtggaatccgagatcatcgaggcggtggaggtgctgcgtcagcacggcgcccaatacgtcctgctccattgcaattccacctatccggctccgttcaaggacatcaacctggcctacatggaccgcctcaaatccatcggcgaatgtctggtgggctattccggccacgagcgcggcttcgccgtggtgctggcggcggtggcccgcggcgccaaggtggtggagaagcacttcaccctggacaagtctctggaaggcaacgaccacaaggtcagcctgctgcccgaggaattccgcgccatggtcgacgccatcggccaagtggaggaatccatgggctcggccgaggcgcgcggcctgacccagggcgagatgatgaaccgcgaaaccctggccaagagcctgatcatcaactgcgacatcgcggcaggggcggaaatccgcgacgagatgctggtggtgcgcagccccggcaagggcctgcagcccaaccagcgcgccaagctggtgggacgcaaggccaagcgcgacatgaaggccggcgacttcttcttcgccagcgacatctccgattccgacgccaggccgcgcccgttcaagttccgtcggccctggggcctgccggtgcgctatcacgattaccgcaccctgctgcccatgaccgccatgccgctgatcgagttccatctcagctatgtggatatggacctggacctggcgcccttcttcgaccagcccctggacgtggatttcgtcattcacagccccgaactgttcgccggcgaccatgtcctggacctgtgctcggaggacgaggcctatcgcgccctttccatcagcaatctgcagcgggtgatcgacctgacccggcggctcaagcagtggttcccgcgcacccggcggccgcagatcgtcaccaatgtgggcggcttctccatggattcccatctgtcggcggatcaggtggcccatctgcacaccttgcttgacgacagcctggcgcgtctcgacatggtgggcgtggagatcatcccccagaccatgccgccctatccctggcatttcggcggtcagcgctatcacaacctgttcgtggacgccgccgatatcgtcggcttttgtaagcgccacaacatgcgcgtctgcctggacgtgtcgcactccaagctggcctgcacccatctgaagaccaccttcagcggtttcatggaagaggtcggcccctatgtcgcccatctgcatctggccgacgccaagggcgtggacggcgagggcatccagatcggcaccggcgacatcgactttgccgccatggctcgccaattggaccggctggccccccaggccagcttcatcccggaaatctggcaaggtcacaagaatgacggcgagggcttctgggtggcgctcgaccggctggaggaatggttctgatccgggccgatccagccgattcagcaagttcggagatgtatgggcgctttgtccggcatgccctggcgggggtgctgctgattgctgccttggggatttcgctcacctacctgatagatccttacggcgagcacgggcaggaggacggcctgtatctggcggcgcgtccaccgaccatcgaccgctaccgcgattttcttgccaaggagccgcatgtactcgtgttcggcacgtcgcgctctcacatgatctcggacgaagtggtcggagagaaagtgctgaaccttttcgccgtctacggctggccccaggccgtttcggctttccttggcggcctggatgaggtgcggctgcacaacgtccgtggaattatctactgtctcgatctccatacattggtggccccggatgtgggggccatctacgagccaaatgggtggtatgggcggttgcgatatcggctggataacctgcgggcttatatccgtgacagtgccggcaaggtgtgggccaaggtgacgggacggcacagctttcacatccacgctcgcggcttcaaggttcaggacgaacgttacggatgggatgagatctggcgtcccggctggcgtaaggagagccagcgtatcgaccctgtcgaggtggcacgcctggcggaaatcaagcggttcgcagaagatcgcggcattccgattctgtttatgaccccgacgctgcccgacctgacgctgaatcgcgacatcgatcttgatgcgctgcggcgtcagcggcgtgccatcgtcggggcgatttctgaatatgtggaattaactcgtattccgggcatttccgatcgcagggagatgttcagcgacgccagccatctgaacgcggcgggccagagggcgctgttcgcccgctatccgtggcgcgaccgggtggcgaaccgccagaatatcgaaggctttctcaacgaactggtcccggaaggacgctgacgggatgctgttcagttcctattcattcattctggccttcctgcccgtgacactgctgctctattacgggctgggcggcgggcggccggtgctgggcaagacggtgctggcggcggcctcgcttctgttctacggattgtcgccggtcggaagcctgtggctgatgctgggcagcatcgccatgaactggctgctgtcgcgcctgatactgtctttccagctggggtctggaatacgccatggggtcctgtggggagcggtcgccgccaatcttgggctgctgttcctgttcaagtacaaggagttcgccctgggactcttatccggcgatctggcgagccatacggcagccacggccattccgctgggtatctccttcttcaccttcacccagatcgcctttctggccgatgcgcatcggcgacaggtggatcaccacacgcccctcgactatctgctgttcgtgactgtctttccgcatctgatcgccggccccatcatccatcaccgcgagatgatgccgcagttttctgacccgcaaacctaccggtggaatagccgccacgtcgccgaaggattaaccttgttcgccatggggctggccaagaaggttctgctggccgacaccatcgccgttcatgccgatccggtgtttgccgcggcggcccccaccttgatcgaggcctggtgcggcgccctggcctataccttccaaatctactacgacttctccggctactccgacatggcggtagggcttgggttgatgcttgggctgaggttgccgatcaatttcgcctctccttaccgagccgggtcgatcatcgagttttggcggcgctggcacatcagtctgtcgcttttcttgcgcgactacctatacatccccctcggagggagccggaaaggcagtgtccggcgccacgcaaacctcctggttaccatgctgctgggtggattgtggcatggtgccaatcttacctttgtcgcctggggtgcgctgcacggggtggggctgctgatcaatcacgcatggcgggcggcccgtggcgtggggcgcccgccaggacggctggaacgcctggcaggggcgggtttgaccctcctgctggtcgtggtgggctgggtgctgttccgcgccaatgacctgagctcagcctttgccgtcttgagagggatgatgggattgaacggtgtggtgatcccggagtcctacgccacgctgccgctggtccgtggtctggtgtccatgggggtgccggcgcgttatctgcctgatttccatgggatcggcgaactggctctgctggcggccatgggagcgcacgttaccctgcttcccaatagccagaccatggctctcgatcgtcaggctccccgcgccctgaactttcgcccaacgatggcgtggtcggctggggtcgccattcttctcgcggtcggcctgtttgctatttccggggattccccgtttctatattttcaattctgactttatccgatcgcggtggctggcagcctgggaacgctcgggacagcgagccggggtcgagtatggtcgggaaggaggtaaggtggatactttgatgtttgatgcgcatgctcggatggaagccgagcattggtggtttgtcggacgtcgtcgggccttgcttcccttatttgaaagtgcgatggcgggacacgagaccgatttggtcgtggatgtgggttgtggcaccggtggtaccgtcggcaccctgggcagaagctaccgcatgatcggaatcgatcagtcggctgaggcgatcacggcggccaggcggaactaccccgagcaatcgttcatcctgggggcggttgccagcgaattggctgaactggctggcgaggcggcactttatctcatcatggatgtgcttgagcatgtggaggatgaccggggctttctggccacggttgtcgaccaggccaggacgggaagtcacgtcctggtaacggtcccggccgggcgccacttgtggtcccgccacgacgagaccgcatctcaccttcgccgttacgagtgggatagtctctccgcccttatccaggggctgccggtcgagacccgcctgctgtcctatttcaattcccgcctctatccccccattagccttgcccggtggatcggccggcggctggccgtaagcctgggccagaacaacaccgatttcgccatgccccccgccccggtcaacggtctgctcgcgcgcctattcggcggtgaggcgacggccctggcggccgccctggaccagggaaggccggcctatcgccagggcgtcagcctggtagccttgctgaggcggcgctgatccttgggcatttccgtatcggacggtcagcgtcccgacggcatgattctgatgggtggtgcatcaaacagatcagttccgccattgatccgccgaacctccagaacaaaccggtggtagtctattgccgggatcatcgggggttgctgacgcagggcgaggatgatcaacaagatcatcccggcggtgctgatgatctgaagggccatcccggccaccgccataatcatcagggatgaccagccgatgatgggaatgctggtgaacagcttctcgatgatcagccacagcgtcgccgttcccaaaaaacccgtcgacacgatagcggccagcatgacacgtgccgccaggatatcggcgtagaccgtcaggccgctgaaggcgtgaatcaacagccgaaacatattcatttttgactgccccaacagacgctgccctcgttctgtcgggatcgaatcgtaggggagccgggctcgctggatgctggcgggaaaatggctccacagttcggcgatgtgggcaagacgcttggtgaggtgtcggggaacgacgctgaagttgccggcggaaattggcagtccggtcgccaatctgtagacttgccggtagccccaatacatgatcttgaacaggcggctttcggagcgcttggagcggccggcaaagacgatccgggtgtcgcggctatccgcgcaagcccgtagcaattccggaatatagtccggcttgtcctcatgatcgccgtccatcacgaccatgtaatccgattgcgcatattccgcgacataggcgacgccgcaggccacagctcgctggttgccttgattgctggccagggtaagaatgtcgatggcaccgattgacggataattgccgctttcaatctcatccaggcccgtcatatcggtggacccgtcgtccacgataaccacccgggcttccatgttcaggggtatcagaaccttatcgatttctggtattagcttcgccacggatggccagtcgttgtatgcggcgatgaggaccgtgaccgacttgccggcaagctggttgacatatgtagtagccattgtcaggaaaattcgtcactgctgtgaaggctggcgatttgccgagattaggccgttcacgggcaccgtgcaaccatgctgacagctatgataaggtccccatggcgtatgcgcggtggtggagtcgcgtttggaatcaatgtgttgatgcattgatagggtgtgtggatgttctttgattttatcaagcaagatgagttgcagggtttggcgcgtctcgcgccatttattatatttatagtattggctgtcatgctttctgtaaagaaggtgggatatcgcaatgtaaaaacaagaaatattattacaatctccatattggctattatgggcatggctgccgagtatgttctgcccggcaactcgtcgttcatcaactttgttgatgagggcgacgtatttgttccgatatatctatattttgagggattgttcgcagggggaagcttcgcgcaggcggtcgcaggcggtaatgatgccatcgggatgctggcgtcgggcggacagttcttcagccttgagatgctgcttatcaaggtgtttcccttgtgggcggccatcgcgattcacaaagtgtccgtgtttggcatttcccttttgggttcatggctgttgcttcaccgtggcatggggcttgcccccattctggcggtgggattcggggtttggtacggcctgagctcattcgacctctatatgtattcgctgcagcatggcattagcatggcggccattccgctgagtatttatctgatggtggtcagggcggataagggtgatcagtattatcgctggattatccccctggcggcattgttatcgaccagcacgctactgacccacagcatgatggcccttatgttcagcctgatggtcgccaccatcatgttgggactgggaaactggcgccggaaagtggcggcgatcactattctttttgtttttgtctgcctcaattgggccgacgtcatcacatccttcacgcagttgtcgcagggtgccagccgtcagcctcacctattttcatttcactcattgttgtcatttaatttctggaggacgtcgcaaggcgagaagctcgtcttcttctatatatcacttataatatctttggctatttgtgtcatatatgctcggcgtgatggtctaaggtacctgtcgggacttgtattctgtcttctggctaatccgattatcatgctgattccttgggagcggctggggttgggatttgtactgggtattgatttcggccggttgacgtacggctttgcggcgctcggtctgattccaatggcgcgggccagtcttatcgtcgcggagcgttggaagtcacctctggctcagggggcgccactggccgtttgcctgtcgcttgccataggtgccctgttgtttcagaaggcctccacgatcgtccaatacctgggcgagggggggcaggcggttctgaccaaggtgccaaacctgcgggaccgtccctggcagacggacccgcatggccgagtggtcaccataccgcacctgattgtgccgtttgcaccattggcttatgggctcgagacgtttgacggctatctcaatctgcagccgatgatcaaggccaggttctggagctacgccaagaagcatctccccatatattcaggacgaaatacgtttattgagaatcaattatacctcaaccgtcccatggcatttgacatgagatgctgtgacaggttcagtctggacgacatgatcgaccaggacttcctccggctcggaggtgtgcgctatgtcgtcagctacgttccccttgggggcaacgggcttcgtcagatatcgggtccacacgcctacgtggcgcgccacaagaagccgttccgccagaagattgaggaggacttgagacagatcgcctcgcccggcgaggtgtttgtttatgaaaccacgaattcgcagccgatcgccttcttcgcatcctcggtcaccgcgctgtcggccgaggcgagcgacgaagaggtctaccaagcggcaatcgccggcgtcgccagtcgcaaggtggccgtgcaactgcccgtggctccgctgccccaggccacaggtcaggtggccgctttggactatgtccctggcggttacgtggccaaggtgattgccccggaaggcggcttattcgtcctgaacgttccgaagacccggttttggactgtcagtatcgatggccggcccgccgaggtgtttgccgtcaatggcatccagatgggggtggagatctaccctggggcaagggagattcgatttgagtaccgtcgtcctcgagtggctgatctgctgcggcgcctgattcaccggtaggcacggacctgatcccggagaccgggaccggagggcggcgcaccccctatgtgatcagggccaacgatccggcgtcctgccgccgggaaaggggaattgctcgatcaccgtccatctggttccttcccgatgcagaaggaacgcggcattaaccggctccagcgacagagccgctgcaccggaataaacgaaggcccagtgggcgggctgggcgtcgagccaggtgcggacgtcgcctcgcgtgaacgccgacaaaaacgaatcgatcgtgacccggccgctccattcataggaggccatcacaccggcgacgccggtaccctgggggtcgatcaccacggcgtgttcgcccgccggaatcatggctcccgccgtgtgcagggactgccgcaggaacggcttggtgcggtcatggtcgaagcggatctggccgaggatcagcaggggccctgccaggaccagaaccagcgcgaaccaccccagggaccgggccatggcccgatgtccgatccgcgccagcccccgtccggcgagcatggctgccggcagcatgatgaccaagccgagatgggtgttgtagcgccagtatgaggcgacgtgctgggattcataatcgccgaacaccaccacataggtgaccagcaggaacaggttgtagcccaggaaggccagggcggccagggcgcacaggcggtccagccgggtgcggtcgcggacgaggccccgcagcccaagaaacaccatgaccgcgccgagcccaaaatgaccgctcttgttgccggccacatccagcatggccagcaggatctgggggatctgcgccacatgccattgattcatgggcaggatcgtcatctctcgcccggcgagatagtgatccacatgccagcgccaaagtcccgatgccatggctgacggcagcaccatgatcagccaatgggtccgaaacaggcctttccatccttcccgacgcagggccaacaggccacttccgccgaagacacagccgaagagggccgcattacccggcttgacccccatcagcgccgctccgaccaagccgaacgccagagcccagcggcctcgggaatgccgatcgtcatcgcacgccacccgctcacccatcagcgccaggaccgctgccagaaaagcggttggaacgtcggcataggccgaaaaggccagcttgtgcacgaaggtgggagacgcggccgtggcagccagaagggccacggccgcccccggcagacttagcttgcccgcggattcctcgcgcgccagcccggccagcagcatggcgaacaatgccaacagcaggacattgagcagcgcgggcactgcctccgagaatcccgacagggtcatggcagcaagcccgaccatgggccagccataaggataggcggcgcaacatgttgccatggccggaaccgacggagcacccggaaccgcatggttggcttggacatagcggaaggcatgcagccagtggctgaactcgtcccattcggagccgcgccggtcggacagcagcagcagcagcggcaacgtcaccatcaggattggcaacccgatgcctgcccacgctcccagttcccgccgatcgcggatcagggcaaaggcggcggcggcggccgtcaggataaggccgatccgcaggtccagccccgcgaccccaagcgcggtccccgccagaatcaacccgcccatgccggctccgaacgcaagcgccggctctgatctgggcagcagaaggcgcccggcgaaggtgatggcaaggattgcggcgaccgaggcggcaacgggacccggctgcaatgtgatccgaccgaggatggcccaggagtcagacaagaaggaggcgatcgccatgaaaagcactgtccttgccgcaatgagggacctagatatccgcagccggtggcgaagtccagactcctaaggcgggtcggacttgaccctgccgccactctcccttaatcagaggcgttcggcgcccggcagctgtcgggtattccggggccgggtattccggggaatgtggacgtccatgaaactgccgccgctgtcgcgcgcctatctggctttcgctcacgatgtgtccatggcggcgctgtccttcgtcatggcgctctatcttcggctcggcgatgacacctggatctggtgggaccgtctcgatctgggcctggccactgccctgttcaccctggtcgccgcctcggtctttctgtcgcagcggctctatcgcggtgtctggcggtatgcctcggtcaacgacctggtggcgctgacccgggcggcgacactgaccatcctggtctttctcgccctgctgttcctgaccacccggctgcaggccctgccgcgctcggtgctgctgatcaattggttcgtgctgctggccctgctgggcgggccgcgcttcatctacagaaccttcaaggatcaccatcgcaaccgccgccgcgcccagggcgaccatgtgcgggtgccggtcttgctggtgggggccggcgacgaggccgagctgttcatccgtgccgcccattcccccgacgcggaataccgggcggtgggtctgctcagctcgcgcggggcgcgggtgggccgtcatatccacggcatcgacgttctgggctccaccgacgagatgggcgaggtggtggcggcgctgaaggccaagggtcaggctccgcagcgtctggtcatcaccgaccatcgcctggacgggtccgaggtgcggcagttgctcgacgacgccgaccgcctgggcatgaccttggcccgcattcccaggatgatggacctgaaggatggggtggaggagcgcgtcaccatgcgccccatcgccgtcgaagacctgctgggccgtccccaggcagttctcgatcgcgtctccatggaatccatgatcaagggccgccgcgtgctggtcaccggcgccggcgggtccatcggcagcgagctggtgcgccagatcagcgatttcggcccggcctcgctggtgctgttcgaggcctgcgagttcaacctctatgccatcgaccaggagatttccctgcgccagccgggcatggagctggtgccgctgctgggtgacgtgcgcgatccggtgcgggtgggcgaggccatggcgcgctaccggcccgatctggtgttccacgccgctgccctcaagcatgtgcccatggtcgagtacaatcccgacgaaggcatcctgaccaattgcgtcggcacccgtctggtggccgatgcctgccgcgccaatggcgtttccctgatggtgcagatctccaccgacaaggcggtcaatcccaccaacgtcatgggcgcttccaagcgggtggcggagatgtacgcccaggccctggatctggccgaaagcgacggcggcggcacgcgcttcgtcacagtgcgcttcggcaacgtcctgggctccaccggctcggtggtgccgctgtttcagaagcagctggccgagggtgggccgctcaccgtcacccatcccgacatgacccgctatttcatgacggtccgcgaagcggtggagctggtgctgcaggcctctgccttcggcatcggccaccccgcctatcgcggcaagattttcgtcctcgacatgggcgagccggtcaagatcgtccatctggcccgccagatgatccgcctggccgggctgcgccccgatgtggacgtcaagatcaccttcaccggcctgcgtcccggcgaaaagctgttcgaggagctgttccacggctccgagccgaccatccagaccgagatgcccggcatcctggtggccgagccccgcgccgccgatgcggctgaacttggtgccgccatcgatggcctggagcaggcatgccgccgccacgacgcggattccgcccttgccggcctcggccggctggttcccgaatacgccgcccatccaccccccccgaattgaccaagccctccggagagcctttcccatgtccgacatccgccccgtccgccgcgccctgctttcggtttccgacaagaccggcctgatcgaattcgcccgcttcctggccaagtcgggcgtcgaactgctgtccaccggcggcaccgccaaggccatgcgcgatgccggcctgccggtgatcgacgtgtcggatttcaccggcttccccgagatgctggacggccgggtcaagaccctgcatcccaaggtgcatggcggcctgctgggcattcgcggcaatgccgagcatgaaaaggccatggccgcccacggcatcaaggaaatcgacctcctggtggtcaacctctatcccttcgaggagacggtggccaagggcgccgattacgagacctgcgtcgagaatatcgacatcggtgggcccgccatgatccgcgccgcctccaagaaccatgactcggtcaccgtggtggtcgacgtggaggattacgccgtggtcagcgccgagatggaggccaaccagtgcggcaccaccctgggcctcaggaagcgtctggccgccaccgcctacgcccgcaccggagcctacgacgccgccatcagtcagtggtttgcgcgggagctgggcgacaccttcccgcggcgcgtggtggtggcgggcgagctgaagcagtcgctgcgctatggcgagaacccgcatcaggccgccgccttctacaccaacggctcgccccgcgccggcgtcgccacggccaagcagctgcagggcaaggagctcagctacaacaacctcaacgataccgacgccgccttcgagctggccgccgaattcgaccagccggccatcgccatcatcaagcacgccaatccttgcggcgtgtcggtgggcaccgacctgaagagcgcctatctgcgcgccctggcctgcgatccggtctcggccttcggcggcatcgtcgccatgaaccgccgcctggacaaggtcaccgccgaggagatcgccaagctgttcaccgaagtggtgatcgcccccgaggccgacgaggacgcggtggcggtgttcgccgccaagaagaacctgcgcctgctggtcaccggcggcatgcccgacccctccgagcccggcatgacgctccgcccggtggccggcggctatctgttccagaccaaggataacggccgggtcatgctgcccgatctcaaggtggtgaccaagcgggcgccgacggagcgcgagctggccgacctgctgaccgccttccgcatctgcaagcacgtcaagtccaacgccatcatctacgtcaaggacggcgccaccgtgggcatcggcgccggccagatgagccgggtggattcgtcgcgcatcgccgcctggaaggcccaggaggcggccaatgccgccggcctggccgagcctcagaccatcggctcggtggtggcgtcggacgccttcttccccttcgccgacggcctgttggcggcggcggcggcgggcgccacggcggtgatccagccgggcggctccatgcgcgacgccgaggtgatcgccgcagccgacgagaagggcctagccatggtcttcaccggcatgcgtcacttccgccactaaggcttttggggcgccccggcacgccgctgcaacagcttgccggggccatggagttcatcgccgtccatgaccagacgccccgacaccgtccgcgttctgatcaatgccctgcacgccaaatcgggcggcggcgtcacctatttgcggaatatcctgccccatctcgctcgccaggagggattggagttgcacctgctgctccatgccgatcagggcgagaccattggcgaactgccgccgggaattcatctgcatgcggtgaccttcaccaacggcttcggccgccggttgctctgggagcagatggccctgcccggcatggcgcgccggctgggaatcgacgtcaccttttccctggccaattacggcccgctcctggcgccccgtccggtgatcatgctgcgtaatgccctgggggtattcggccaggaatatcgcctgtccaagtggctgtattgggcgggcctgacggcagcgaccctggcctcgctggtggggtgccgggcggccatcgcggtgtccgattacgcccgccgcgccatgggattcggcattccggccctgttcaaatccaagatcgccgtcatccaccatggcgttgaccgccgcttcacccctaccgaccagccaacggagcggacggaaggggccttgctggccgtgtcggacatctacgtccaaaagaattttcataccctgatccgagcggtggcccgggtcaggcagacacaccccacccttcgcctggacatcgccggacggctggtggatatggaatatcatcaggaattgtcgcggctggccggagattgcggggtgagcgactgcgtccgcttcctgggaagccgtactccggacgaactggttgcgctgtaccgtggctgcgatgctttcgtctttccctccaccgtggagaccttcggcaatcccctggtcgaggcgatggcctgcggcacgccggtgatctgctccaacagcgccgccatgcccgaagtggcgggcgatgccgccttgctcatcgatcccctggatgaggccgccctggcggcggccatttcccgcgttctcgacgaaccggaactgcgtgccgatctcatccggcgctccctggctcgggccgccgatttttcttgggaaaagaccggcgccctgaccgccgcaattctgagacgggcagcgggccgctagccctttccgttcagcgcaggtgttggtacaggatcgaggcgatgcgctcgctcgccttgccatcccagaattcgggaatccggccggtcttgccgccgctggccaggacgtcgcgccaagcggccaacaacagggcgggatcggtgcccaccaccgtgttggtcccctcgctgaccgtgatggggcgttcggtattctcgcgcaccgtgatgcagggaacgcccagcgcggtggtttcctcctgcactccgcccgaatcggtgatgaccagccgcgccccggccatcagccccagcatctccagatagccggcgggtggcaacagcaccgtccgggcattgtccagacgatccatcagcccggccgcctcaatcctcgcccgggtgcgcggatggatggggaacaccagcggcgtctggcgggcgatttcggccaagccgccgagcagcctggccagcaccacgggatcgtccacattggacggccggtgcagggtcaccagggcgtagcccgtgcggaaatccgctcccactgcctccagggtggcggtggccgggacggcgcggggccgattcatgaccagggtatcgatcatgacattgccgacgaagtgaacccgggccggatcaatgccttcgcgggtcagattggccagggcgtcacgctcggttgtgaacagcagatcggaaatctgatcggtcagaacccggttgatttcctcgggcatggcgcggtcataggaacgcaggccggcttccacatggaccaccgtcactcccttcttggcagcgaccagggcgcaggcgatggtggagttcacatcgcccaccaccagcagggcctggggcgccagatcgtccagcacgggttcgaagcgccgcatgatctcggcagtctgctgggcgtggcttcccgagcccacttccaggttcacgtccggccgcggcaggcccagatcggcgaagaaccggtcgttcatggcctcgtcgtaatgctggccggtatggaccaggggggccgccatgcccgcccccttcaaggcgcggatgaccggcccgatcttcatgaaattgggccgggcgccgacgacgcacaaaaccttgggagcggccatggccgacaccctcagaaccggcgctgggcgatcagatcacccggcatatggctcatgcggatatactgggccagaacatgcatcagcgcctgatggcagtcttccaccacgccgtaattgtcggcttccacatgcagggccacgtcggccagatctcgcgtccgtccgccctcgaagccggtcagcgcaatgctcttcatgccgatctcacgggccttgagaatggcgcgcgtcacgttttccgaattgcccgacgaactgatggtgatcagcacgtcgcctcggcggccaagcaggcccacctgataggaaaatacctccgcatagtcgatgtcgttggcgatggcggtcaacatctccaccgttgccgacagagagtggacgcggggcttcaggccggtgtcggtgcacacacctttggtgtggtcgcagaccagatgattggagatggcggcagatccgccattgccgcaggaatagagctgggcatcagccgccagcgcctcgctcaggagcttcgccgccgccgcaaggtggtcacgagacacggtcgccagggcgcggttcacctgctcggcgtaggcgtccagaaagccgccgatattgggaaagccttgatcgggaaaactcatatgacctactcgtctcgcatttgactgggcgacaataggggtgccaaggcggtggcccaagccgccagaaaccacatggtgcactgccaccagctttgccagaagccaaagctgaccgatgaaacgacgcaagcccccaccagcagggcaccgccgcagaccgccatggccggcgactgcctcgggccgacggccagccatcccaggcgcgccagcaggacggcaaataatagggcaccgacaccccccagttccagccaccattgcaacacagcgttatgggggtgaaggggcaggtgctgttcggcgacctcggctcggctgctaccgtcgctgccgtgccggaactcgaaatagacgatctcgtcatcctcgccgccgggaatggcacgggcggaatccatcccccagccgagaacaggacgctcgaagatgcgatcggtcacgaagccccaaatggtcaggcgatggtgggaggaataggggacgaaagcccaattggcgctgacctgcggcgggggcaacatccgggtcccgaggggaatgaacaccaccagggcggcaagaaaggcgcccacggtgatgccgagcagcctcgatggtttgcggaacagggccagggccgccagttcgattcccagcagaacctttgccgcaagggccttggatatgatcatcatcgtcacgacgggtattccggtcgccgccagctgacgctgccgcctttcgacccaaaggagcgccatggcaggaagcgcggcgagcgccgtaacgcaaacgcctcgattgaagacctgaatcgaaacccagtaatatggcaggagatcccgattttgcatcgctctcaatagagcttccagacgccggccgctcaccaacccgatcacgaacagccccatgccgaggacgatgccgatcatcagggcggcaccgacctttgcagcggcctgcgatcgcaaccgcttggcggcgccaatcaggatgacgccgccaagcgtgttcagcgccagttgcgctgccgccaacaaggagcgggccgggtcgacggcccacagggcggtcagccccgcccagccgcagatcatgcagagaatgagccccagaaagcggggaaaagccgtccagagacgctgacgccattccagaagcagaatcccaaggacagtggcgataaacagcggggccatgcccaacggcgccagcatgccgatgccgggggcaaccagcgccgccagggccaggatatgggaggcatcccaggggcttgccatcgcccgccgtattttgccgacgatctccatcatgcccccgccccgattgcggtggcaggaacgggctgcaagccgcgttcccaggcgtcaagcaccagcagcgaccagattttcagggaatggtcccgccgtccgccggcctgctcggccagcacggccgccacggcgggtgcggccaggcccagttcctccagccgcttcggcgtcaggcgctcggccaccatggccttcagaggcccttgcagccacatgcccagcggcggattgaagcccagcttgggccggtcgacgatggcgcgcggcagcagcttgcgggccacggcgcgcagaagggtcttcttgccctcggcgaagcgcaaggacgcatccaaccgtcccgccgcctcgatcacccggtgatccagcagcggcagccgcaattccagggcgtgattcatgctcatggcgtcgccataggccagcagattgccgggcaggaaggtggccaggtcggtttcctgcatggcgtccagagcgttctccgacaccacctcgccatagcgcgccgcgatggggctggcgggagtccgggcgaggcgcaacagctcgcggcgttcggcgggcgaaaaatactccacccaggcggcgtaggtttccgccccgtccagcccggtgctggccaggaattcccgggcccggcgccaggcgtggcggccgtcgctgcgctcggggatcatacgggccaggggcgccagcagattgcggcgcaggacaccgggcagcagccgcaccctctcggccagcaatccgccctgatagcggggatagccggcgaacacctcgtcgccgccgtcgcccaccagggcgacggtgacatgctggcgcgccaggcgcgacagatcgccgatcaaaagggcggtgggattgccgaagggctcgccgaaccgctcgatcatggtgtccaggccatcggccagaccggacgaggcgggcagttccacatgacggctgcccacatgggcggccacctgggcggcagcctcgcgctcgtcgtaatgaacttcgtcgaaggtcatggtgaaggtgcgcaccggatcggcggcgccctcggccatcagggcggccaccaccgaggaatcgatgccgcccgacaggaagcagcccacctgcacgtccgagaccaggcaatccttcaccgcccgacgcagcaccggcagcagttcctccaccgcctcgtcctggccgggccggcggccgccgccatagatcggacgccaccacacgccgatagtcgccgccttgcccggactccagctcagccacgagccgggcggcagtttacgaatcccggcatggatggtgcggggcgccggaacgtagagacaggcgaggtactcggacagagcctcgcggtccagggacagatcgatgcccggcacggcgcgcagggcgtgaatctccgaggcgaaggcgagaccgccgcccggcagcgccgcccagaccaggggcttgatccccacccggtcgcgggccagcagcaattgccgcgtctggcggtcccacagggcaaaggcgaacatgcccaccagcctcggcaggcattcaacgccgtcccgcatcagcaggcgcagcagaacctcggtgtcgctggcgctggtgaaatgctcgcccaccgcctccaactccgcccgaagttgggcatggttgtagatttcgccgttataggccaggacccagcggccgcagggcgagaccatgggctgggcgccggcctgggagaggtcgatcaccgccagccgggcgtgaaccagacccatgccgctgtccggctcggtccaacggccctggccgtccgggccgcgatgggccagacgcgccagcaggcccgccaggatggcgggctgggcagcggtggttccggcgatgccgcacatgcagtggttccttggtcgcagactcccgctctttaccctgaaatcggccccaggaccagtttctcgactttggaaatgaaatccgccgcccgggcgtgtagtgtctggccgcgcttcgctacaacaacgggagagggccgatgccggtcaccgaaacggtcacgctgggcaaggatgtgcggatcttccagcccgatctggtgaacctctacggctgttccatcggcgacgagaccaagatcggcgccttcgtcgagattcagggcggcgccaccatcggggcgcgctgcaagatctcctcccacagcttcgtctgcgagggcgtcaccatcgaggatgaggtgttcgtcggccacggcgtgatgttcaccaacgacgtctatccccgcgccaccaccccggacggcgccctggccaccgccgccgactggacctgcagcccgaccgtggtgaagcgccgcgcctccatcggctcgggcgccaccatcctgcccaacctgaccatcggcgagaacgccctggtagcggcgggggccgtggtcaccaaggacgtacccgccaacgccatcgtcgccggtgtcccggccgtggtggtgggcgaagtggcggacaagcgctagaaatgaccgatatctcgtcctacgcctatcgctggccccatggcgatcttgcggccgattcccactggtcgcccaccgcttcgggccgcttcctgacccggtccatgccggaaagcctggccgacctggaagccgattcccgctggccgtcattctttccctgtcccctggtgctggtcaccacaagggacggcgacagggtgctgctggagaaggtggtgggggcctcggtggtcaaccgcttcccctataccctggcgctcagcttctgcacccagtccctgtccagccgccattacgtgcgccgcaccttcatcgacgccctcgagcgctcgggctcggcctcggtgcagttcctgccccccggcccggccctggacgccgccatgaaggccatcgtcgaaggtccggaagagcagaccgaccagcgcatccggaccagcggccttgccacccgcccggcgcggaccaacgacgcgccggtctttaccgacgcccacatggtttatgaatgccgtctggtgaagcccggccgcgacttcgaaggcgccgccatcaatgcccggccctatgccgacgtgggcagccaccgcatctttttcctggagatcaactccatccagttgcgcaaggacatcgcccggggccagagccagattcactggcgcgccctgccgctgttcacgcccgtgctggactcggccaccgccgccaccggcgacgcggacgaggccctgaagcgcctgggctacgtcaagggctacacgccgcgctacgccttccccagcgccggcaccaccgccttcgaggccgacggcgaggccgacggcatggcctacaaggatctggcgccgctgcccaaggatcaggtggaggtggacaacgaccgcgcccgctggccgtgcttcttcccctcctcggtgggcatgatcaccagctggaccgccgacggcaaagccaacgtcatgccctgcggctccaccaccatcgtcagccgccaccccctggtggtggcgccctgcgtctcctacgccgccatcaacgaccgctatgcccggcgccagtccctggacgatatccgccgcaccggccgcttcggctgtggcgtgccgttcatcagcgaggccatggtcgacgccatccgctattccggcaacgtctccatcgtcgatgacggcgacaagctggctcatgccggcctgtccctggccgagggcggcgccagcccgctgatcgaccagatgccggtgcatttcgactgcaaggtgacaggcgagatctgcctgggcacccatgtgatgttcctgggcgaggtggagcgtctgttcgtgcgcgccgacgtgtcgcccgccaacccgctggaatggattccctgggccgatgtgcgcccggtgcaaggagcttaaggaatgagcggcaggattctggtcaccggcggggccggtttcatcggcagccatctggtggatctgctggtctcccagggccaggcggtcaccgtgctggacgacttctccacgggcgaggccgccaatctggccgaagccggcggggcgggcgacgtacgggttctgaccggcaccatcctggaccgcgacgcggtggccgccgccatggagggctgcgaccgcgtcttccacctggcggtgcagtgcgtgcgcaaatccctgggccagcccatcgaaaaccacgacgtcaacgccaccggcacgctgtacctgctggaggaggccagaaagcgccaggtgtcgcgcttcgtctactgctcgtcgtcagaggtctatggcaacggccgcgattccttgctgaacgaggacaggacggtgtgcgagccggtcaccgtctatggcgccgccaagctggccggcgagctttacgccaaggcctatcaccgcacctacggcctgcccaccgtggtggtgcgcccgttcaattcctatggcccgcgcgagcattacaagggtcagagggcggaggtgattccccgcttcctgatccgggtgctgaacggcctgccccccaccattttcggtgacggcagcgccggacgcgacttcacctatgtcaccgagaccgcccgcgggctggccatggcggcccagtgcgacgccctggtcggccgcgagatcaacatcgcctatggccgcatggtgaccgtgaaggaggtggcggagtccatcacgcggctgtgccagcgccccgacatcgcccccagctacggccccggccgtcccggcgacgtcaaggccctgcacgccgacaccgccctggcccgctcgctgctgggcttcaaggccgagatcggcttcgagcagggtctggaaacctatatcgactggttcacccgccaccaccccgacccggccagcctgctggaagacaaggtggagaattgggaactgccgaagtaaggctcagggccgcttgacgatcaccagccgggcgtccctgaagcgaaccacgcgctcgacccaaggctggctctcaagcgtatcgagctctgccgggcgagccgccgcgccgccctccacgtattccgcatagttcagcggagaactgagatagaggtttggccatcccttgcgggcaaggatacccggaaagtctgatgattccttcagcgcatcctggatttccttgctccagtagtcggaatcctgtcggagcgagccgccaacatagttccgcaatcccatgcccggttcgcagaaaaaatacatcagcggccggtcggcgacccactccaccggcaccccctcggcggccagggccagcgcaatcccccggtcgatgatctggccatcgtagatttctcgcccccagttcaaggccttgcccgggccatagcctgtggcggcccccaccgtcacccacaggagggccatcgccagtgtggaagccagcccgatgcggaccacacgggccgccttgtgcgccggggccagccagcgcagggcgaaggcagggtaaaatgcgccaaacattgccgccagcagataaggtttgttgctgactcccgaggaacggtagccggtcaccagttcgaggcagagcggcaggagcatcaccgccaatggcgccaatagcacggatagacgccgcggctgccgcaagcagcgtttccggtccgcagccagcaggaacagcagcgcggccagccacaggcttctgggacccaggggcgtccacgagcctccggtcattagcccccagtcgtgcagcatacccttcagatgatacagccagccgctgccgcccatgaccagcaggcgcccccccggatagaacggggtcgggtgcaggatatagccgatctcacgccacgccagcagccccaataatccggcgatggcggcccaggcgggccaccagcccaacagagtgcggaacccccatctggtcatggcccaggccgccattccgatcatcagcagggctgcgaagaaggcggcgtagtggcgtgccagcacgagaaaggccgcagccgtggcggcggtcaggatggaccttcggccgcatggtcgcgaggccagcgtcgtcatgataagtgagccgcccaaaatcatgaccgtatcgccccagtggcggccgatgcccgctcgcacctgaaagtcggcaaacatcaggccgcccaggatgacgagataggccacttgggccagcgggcggcggcgcagcgcggcgaggggcaaaagaacggccagcccgacccccaggacggacgtcgccaggtacggcggatagaaatgctgcgcgccaagccctccggccagtgcgctgactcccagcatgtccacggaatagaacaggctgcccaccggcccgattccgaaggcgaaatctccgggaagcagaaaactgccggcgacgaacgactcacgcagatagagggggacccagcccagttgcgatgagaggctggtggacggatttatctgcaccgtccgcagcgcccagaaggcgccaccggccaaaatcatcaacatccagtcggtccggtcgagcggtcgctgcgccaggggacggggcagggcccaccggcgcaggatgaacgacagcattcccaccagggtaacggtcaggggcaagtgccaggcaacagggccgagcgccccccgcaacaggaagagagccatgtcggctgccgccgtcaggaccagcaggccgaatgaggcgccctcgatgcccggtcgcccgagaacacggccgatcaggacggcgggtatcagaaaggcgaccacccatccagcggtcaaggcttcctgcggacccgacaccaacaatgccaggaaggtctcgaaatcagcaatcatggacgggaagaggggggagttgtcttctttgcctcaaccacgaagggcggtctctggcgggattgatccagcgcacgccatagatactcgcctaaaatgcccatcatcaccatttggatgccgccaatgaccaagagaaccaccatcagggacgaccagccctccggctggccgccaaacagacgggcgccgatgacgaccagggcataggcgaagcccatcagggccgtgaccagcccgacgcccgacatcaggcggatggggaggtaactgaacccggtcaccgaatcgatgaccagtttgagcttcttggccagggaccagctagagcttccgtgaagccgctcgccccggcggtataaaatggacgattgacgaaagccaacccaggacaggagggcgatcaggctgacgtgctgctcattgaaccgcagcaacgtgtcgacgacaaagcggtcgagcaaaaacacatccgccccgttgggtggcaggttgggaaggtcgaccacacgtcgcatcagccaatagtagagcttggcgaaccagagattcgcacccgtgtccccccttgcctcgcgctctgcccagacgacttggctgccgacacggcgccattcctccagcagcgacaagatgacctccggcggatcttgcaggtcggaggacatcacgacggcacaatcaccccgagcttcctgcagaccgcaaagaattgccttgtgcgaaccaaaattgcgggagaagcgaatcgcgcgcacccggctatcaacgtcggccaatcctgtcaggatctggaatgtcgagtccgacgaatgatcgtcaacgaccacccattcccactggattcccgcctgatccagagtttccttcagccgctggtgcagaaccggaaggttctgctcctcgttatgggccgggctgaccacactgagcagcatcccccctcctatcgcagcgagttgcgcaatgcggcgatcacctgatcctgatcgccgacggacatgtggggaaacagcggcaatccgagatttcggcggtagacatcctcggataccggcagaggaaaccgtaacggccgttggttgtgggccttttccaaatgacagcagaaggttggacgacgggtctgaacacctgcctccagcatggactgcatgacggcatcacgatcgatgccaggctgcagcagcacattataggtctgccagttgctgcgtgcccaggacggctcgacggggaattccaggccgggcaggtcggacagaagctccacgtagcgagccgcccactcccggcgggccttgatgatggcaggcagacgaacaagctggcgcctcgccacggcagcctggatatccgtcatgcgataattatagcccacctcatcgaaggtctcgatgatcacttggctggaattattgcgggtaaggtccgacacgctcatggcgtgctggcgccaacggcggaccttggcgtcgaactcggcatcgttgctggtaatgatgccgccgtcaccggcggtcagcaccttgcgcggatgaaacgaaaagcatgcggcgacaccttgcggcttgccgataggctcccactggccatcgatctgaatctcggacccggcggcgcaggcggcgtcttcgattaccggcaggccgtgtcgattggccaccgccaggatggcagccagatcacagggcatgccgaactggtgtacgcataagatcgccttggtgcgcgacgtgatggcggcctcgaccaaggccgggtccatgttgcgcgttccccgctcgatatccacgaagaccggccaggcccccaggtagcggatggcgttggccgtggccaggaaggtgtagctgacggtgatgacctcgtcgccctcgcccacaccgacggcccgcagggccagatgcagcgccgtggtgcaattggagacggcgcacgcatgggtggcggtggtcgcgccggcaaattcccgctcgaactccgcgacgcgcggcccctgcgtcacccagccagacatgacggcgtcataggcggcctgcgcctcttccggtcccagcatcggtctggagaattggacaacccgggtgtcgttcatggactgatggcctttcgagaattcctcagccttcataagcccccggggacatgcttgccaaggccaacctcggcattcgaccgccagattggcgagcaccccgaaaaaatgctatcgtccgtcccttcactttccatgatgaaggaccagttcgcccatggccgacccacatggcttcgatcatcttttcgacgacgatacaaatccggcgttgagaaatcaaatcctgacctaccgcgtttccgagacgatgaccgaccgcgaacgagccagattactgaaccttcccgagggttgccgcatccgtgaacgtgcgaagattcttgcacccgagaactttgtttgcggcaagaacgtgtggattggggagggggcgatccttgacgccatgggcggcctcgaaatcggtgataattcacagatcggctcgtacgtcatggtctggagccactccagccataagcaggcaatccggggtgagacgggaacatcgcgggaccgtatcgagtataaaagaacgaaaataggcagtaacgtccatattcccggcccgacggtgatcgctccgggcgtcaccatcggcaatggcgtgatgattgcgccgcttagcttcgtgaacgaggaccttcccgacagggctgtgttcagccccgccagggaaatgcgccgcttgcgcaccaggattgaccagttggaaaagaagctggaagaaatactctcttctcgagacagctagaggctggattgctgccgcgcggcaaaataggatcccgctattttccagcgtcaatttgagttgttgtgcatgacggcggagtcaatgtctcgatataattatttatattatggaggatcttgtttatttctcgtggttgtcattatatttctgatgaatatgtaagatttgccatatcagactggatatgaagcctgacttctgcctgcggcggccgtgtctatcaatgagggattgtcttaatgagtgatgccttctcttcttttggctctggccgcgtctgcaccaagcattccggcagaagctgtggggtggcatcattaattattcttgtcgctatgacattgccatccataattctagttctaagcatggccgtcggtccaatgaagcacttggatgagccgttggatataatatggatgcagtttccgcggaccatctcggcctttaattcccagggctggttatttcaggggatgggtcttgactcggtattgagccagcgtctggcatgtgtcgctattgaggtggccgccagcttgttgcttgccaagggagttctggcctatttcaaggtgtttcttgacctggaaattgaggcattttgggtctacgggctgtcgttgacgggcgctctgctcttcccccatgtcctctacctcactccgttgccgtcctatctggtcagttcttcattcaacgcctgctttggcctggtgttgtggtcggtggcggccggccggtccgcgcggatgtccttggtcgccggaatggccatgggggtcgtcccgatattttggccgccgatggctgcaattgcccctctcttcatgagtgttttcattctcggcacggcatgcggccgcgatggaatgctcaagggcgcccggcaattggtattcattatgtcgggattcattgtctcctttggtgggttctacgtaatcacgggagatgggccgcgccttcttgccgcattggctgttatctctcggaccagcaggcccatttctgttgttttgacccataatgtcgacgacgcattgcatatcatcaggtctgcgctaaccatgcgggcatttcccccgtttgtcgcagcgattgtggtcgtggccctgtcttgggtgctcaggcggttcaccacactggcagacgtggctttttccggactggttgcgatcggttgtttggggttcgcggtgggaacggtgctccacacaaccttgtatttccccttgccggctggaatggcgattgcgttcgcatcgacgatcgccctttcccgtcacgccttcgaagggagagtggtggccggtcgcttccaagctgtctggctgttgggcactctgtttctattgccctatgtgccatttttcggatcgagtcggggtgtggtctcagtggcggactgcaatgtcgccccgctcttcatactgtgcggtcttgctcttggggtattggcagccaggggaagaatatgcggcttcgcggcgcggggggctgcagtcgcactggcgttctgggcgacgatgatcacggccgagcgggcgatgcttttatggcgtgaaggaagcgtgcccctggcgtctccgttgccggaatttcgggcgttgcgagccacgcccgagcagaggctgtttagcgacgagctatatgcgctgctggcgggggccaatgtcacgcggcaaggatggcgtgtggcaggctggctttcgccgacggccatggcgctttccgggttgcgtccattcgggagtgatttcggcctcggggccggcagcctgtccgagtgtgaaagcctcaaggcggacacgctggagccggaggagcgtctggttctgatcggctccgggtcgccgggagcaagctatgtgcaatgtcttcgtgcggtcggcctggactttcccgaggcattttccgaaattgggcgcctgccgcccgaccctctcataccgcaagaggggcgtgggcaggactggattgtgtgggtagagaaggcgaaacggtcatgatcgatatcggccacttgttcgtgtgccccctttgccgggaaggtctcacgtcctcgggcgacggttacgcctgcacctcatgccaccgtcattttggaaaagcaaatggggtctgggatttcagggtcgagcccgccgctgccgagccgccgctttacagcgatccctttttccgtcgccacagggaatgtctggcgcaattgcacgcccagcattacggcgaaaactccatgtccggacagctcgaggaccgctttaagcaggtcgcccggaagctgatggagacggagcctgattttgtcggagatatcggctgtggaaccggcggtgctttcagtaccttcggcccgccatcgcggatgatcggggtcgatcaagacattaagctgttggaagttgccgcgcgcagatatcccgaagccactttggtgtgctgtgaccttctgcgctctccgctgcgccaaggtgcgtttcccgccctcatctgcctttgctgcctcgagcacgtatactggctggaggactcgttggcggtaatgcacgatttgctggctccgggcggccgtctctacgtcatgattccgaccgaaggcgggcttgcctggtcgacggcccgtaacctcttcaccttgtccgtgaatgcaaaaatatcaggcatgacaaatgatcaataccgccacgtgatgcgaattgagcattgtaataattttgaggctgtaaacagcgcactgttcaaatttttcgaaatagagcgctttaatttctggccgatgggtattggtgggcatcacttgaacctcattggcctctactccctgaagcggagaacatcacagatgatggcgctcgcttccaagagttagttgttgacataaggctgccgaatggtgctattttccccgagttttcagtgatgtcggcctcgtgccgggatgaggcgaaggccaagatcaatgtcgtcttatgaggggcaggctagggaagattcgggggaatccttcgaactggtcagtgtgatcgttcctggttacaacgaagccgacagcattgaagagttgtacaggcgggtcggtgccgcgcttgatggcattggtcaaccgtttgaatttatttatgtcgatgatggaagtaccgataattctttagaaattatcgagaagctgcgcaagacgaagcgcaatatcagggttatttcccattacatcaatcacggcaaatcgttggccctgatgcaaggattcgacgcggcttgcggtgatgttgccgtgacgatcgacgcggatctccaagatttgccggaggaaatcccggcattacttgccgaattgcggcgcggttttgatttggccaatgggtggcgcattaatcgccgggatacgtttgccaaacgacaggtttcgcgtttctacaacgctttgaccaaccgttttctgaaatgctcggtccacgacatcaattgcggcctcaaggccatgcgccgcgatgtatacaaaagccttcaactgcgaggcgaccttcatcgcctgataccggctctggcggccggcaccggttttgccgtttccgaggtcaaggtggaccacgccgaccggaagtatggctcgtccaaatatcgactgctgcgtcaccgcggtctgctggacatcatcgtggtcgcggccagccaggcgggccggacccgtccgttccatgtgttcttcgaactgggcatcacgatttttgccatcgtcggcctgccgtccttaatcgcttggttgctggtgcagttcgtggcagaacccggtggcgcctgggcccgggtctggagcacgggaacgctgctcttgttcgcctggtcgctttgcgtcgcgaccatgcttcccatcatcggcttcgtcatggacatcaacaccgctcgttatcaggattatgactggcggcggaaactgctgcgcccagggaaggcggaccctgccggtgagccctgatcgggtttggcctcagcaggcttgaattccgcagcccggatatgcaagtctcgattaatcgctaggacgagcgcgttaaacccctggtatttctgcgggtttacttgcgacaacgggacaatgtggcaggctcttggcaatgattgatgcacttctcatttacccgcgactgggcactatggatgcgctggtcacggatatcccactcagcttgatctatgctgcttcggacagcgtcaagcgtggatatgccgtcaaggtcgtcgatctgcgtattgagcgggaggactggcgtgaggtgctcgccccttacctgcagcaaggtgtgaagctggtcggcatatcggtgatgaccggccggccgctggtcaattcccgcgacatttcccaattcgtgcgcgaagtggcgcctaagaccaagatcatctggggcgggccgcatcccacggtggttcccgacacgatcaaagagacgtacatcgactatctgggtcgaggctacgggtcggaattgctggcctccttgcttgatctgctcagcggcaagcgggacgacatggagatccctggtctgtcgtacaagcaggctgacgggactccggtgcacattccccgtccgagcactttcgagactctgagctacaaggatcttccctaccagctgatcgacgtcaaccatccgggatacgtccgcagctacaataaccagcgcatcttcccgatctttaccagcatcggctgcccgtataagtgcaatttctgcgtctctccagccgtttatcgtgagatcaacggcgccaagtggcgaccgctggagaacgaggaggtcatcaaccatatcgaataggccgtaaaggaattcggcgccaagcacatcgtcttcctcgatgataccagcttcccgaaaatcgatcgcatgcgctccctgttcgaggacattctccagcgcaaactggatgtgtccttggagttccgcggcgcccgcatcaacgaactggccaagatggatgacgacttcctcgacctcatgtgccgggccggcggccgggtgctgatggtcggcgtggaatccggcagcgaccgaatcttgcagaaattccagaagggcatcacccgcgcccaggtgatcgaggtcaatcgcaagctggcccggttcccgcaattggtgtgcatgtacaatatgctctacggcgcacccggcgagacctacgaggatcttctggagaccaagaacctgatcctccagctcatgaacgaaaatccgtcggcctatgtgggggccggaggtgactggaagcccattcccgggacccagttggtggagatcgccaagcaggagttcggctttaaggagccgtccaccatcgatgagtggatcgagatcgacacttcggatgccacggagaagatccgccatccctggtacaccgaccggcaagacaacctgatccgcgtcctgcaggccggtgtcttcgttatcgaccgcaagtttatcaaagaaagcgccaagaacaagacgttggtctaccgggtgatacgcaccctggcccgcatctatcgcccattcgccatggcgcgtctcaaccacgatatttattggcttcccatcgaatacgacctgatgcgtattgccgggcgggtggtggcaagtctcaagaagcaggcggcctgacccatggcaaaagctgtattcctgaagccctccgcggggggcaaggaccgcaatatcgttcgcgacttcatttatggttgctggtgtaacggcaagcgggtgggcggcatgtccatgcctcccctgcacgagttgatggcggcaacccatgcccgccaggacggactggagatcctgttcgtcgacgcccagtacgagcccgagcgtttcgccgcgctcgaacggcagcggttcgacggtgtcattgccatctgcatgatgagctcgacgcagtccttccgtcaggacctggaggtgatccgcgccatcaagcagctcaatcccaaggtcaagagcgtgctgtacgggtcgcatcccactttcatgcccaatttctgcctgaaggagcccgaggtcgacttcatcgccacccgggaggcggaggagagcctgcgcgaacttctgggtgcgctccttaacggcgacaattgggaaggcatcgccggcatcggctggcgcgacgccgatggcaagccgcagatgagcccgacgcgggcgttcgccaacatgaacgacctgcccattccggaccgcaggctgttgccggccaaggtcgactatttcaaccccatggtgaagcgggtgcccttcaccacgatgatcacctcgcgcggctgccccgcccgctgcaactattgcacggcgccgaccttctacggcaacaagacccgcgcccgcagcaccgccaagatcatcgaggaactgcgcgagatccgggatctgggttatcgcgagatcttcttccgcgacgagaccttctcggcctacaagggccggaacatgcaggtctacgagaccatgctgtccgagaacctggacttcacctggatcgccaatggtcgtgtcgacatgattgatcgcgagcaattggccctgatgaagcgggcggggtgccacaccctcaagttcggcgtcgagaccggcagccagatgatgctcgatacctacaagaagggcacgaccatcgagcaggcggtggaagcgttccggacggcccgggaggtggggatcaacacccatgcccacatcatctttggcggaccgggcgagacactggacaccatccgccacacggtggatttcgtctccaacacgctgaaggcgaccaccgccacgttcggaattctgaccccctatcccgggacggagcttttcgacatggtcgccgagcgccaccccgagatcatggacggttccgcctcgaacatggagaatctccataccgagagcttctattcctccgccctgtgcgatattccgcctgagactttgtctaaggagatcgtccgcgcctaccgtggcttttatctccggcccgcctatctgctgcacaagctgcggctgatcagcagcatcgaggagttcatggtcaacgtgatcgctgggctgaacgtggtctcgttcgccgtttccggaaagaagtagcagccccctgggggccatagacccgggggaagggtatgtgcggcattttcggtatggtccgggggggcggtcggccggttgagtccaatgtgctggccgccatgaagacggccttgcatcatcgtgggcccgacggcaacgggatcttcgccgaggggccggtgggtctgggcaatacccggctggcggtggtcgataccgccggcggctcccagccggtgatcgacccgtccagcggcgcggccatcgtctataacggtgaactcttcaaccacctggaactgcgcgcggaactcgaatcggtgggctggtgcttccggacccattccgataccgaggtggtgctggctgccttctgcgtctggggcgaggattgcgtgctgcgcttcaacggcatgtatgccttcgccgtgttcgatcccaaggctcggagggtattcatcgcccgtgatccggcgggcatcaagccgctctatctgaccgagaccgcggatggtctggccttcgcgtcggaagccaaggcgctgttgccgatcgcgggacgccgccctgactggcaggcgctgtggggctacctcacctatggctatatggcgccggattgctctccctttgccggaatcaccaagtttcccgccggttccctggcctggatcgacctggagctgccggcggcgcgtcttgccgtcagaccctattggcagccccggttcggctgcggggctccgcttgccgagggcgaggccgtcgaccgactggatgcgcttctgtcccaggcggtcaagcatgagttgatgagcgacgtgccggtggggcttttcctgtccggcggcctggattcctcggcggttgcctattacgccgcccgccgccacggacaggccatttcctcgttcggcctggccttcgaggaaacgacccacgatgagtcgaacgatgctcgcacggtcgccaggcatctggggatcgagcataaggaactgatgttctctccggccctggtgcgcgaggggctgcgccgggtaacggagaccatggatgaacccttcggcgattccacggtggtgccgctgctgatgttgtcgcgcttcgcccgcgagcatgtcacggtggtcctgaccgggtggggtggggacgaggtgctggctggctatccaaccttgaccgcccatcgggtggccagcctgtatcgccgtttgccgggaatgctggcccatggcttggtgcccgccctggtcgaccggctgccggtctcggacaagtatctgagctttgaattcaaggcccggcgcttcctgcgcggtatgaaactgaccccagaacagcagcattttctctggatgggctatttcgacgacgccttcaagcatgccctcctgactccagatgtgacggcgcaggtggcgcagcaggacagcctggcgcactttgccggcatggccgccgggatggcggagccgaccctgaccgaccggatcatgcatctggacttccgctacttcctgcacggcaacggcctttttcaggcggatcgcatgaccatggccgcctcgcttgaggcgcgggttccgttgctgaacaagcagatgctggatttcgctctgccgctgcccgccgggctcaagatggcgggtggcacgccgaagggattgctgaagaaggccctggccccccatctgccgcctgccatcctgagcaagcccaagaagggattcgggccgccgtcggggcattgggtccgttcggtgtttggcccgttgctcgaccatttgttcagccgcgagcggatcgaggcccagggcattctcaaccacgccacggtcgcgcgcctgctggccgagcatcgggaactcaaagccgaccacggccgtacgctgtgggcgctgatgtcattacaattgtggtatgaccgtttcattctggatcaggcgtcccccctggaacgcgcggcatgatcacgtccctggatgcaccggcccgccgcgccttttaccgcgccgaagtattgcgttacgcaccaaggctgctgtcccagttggatcgctgccccctgtcggcggcggccggttccgccgaccgggaatactgggcctgggcgacaaaggactttgccaaccaggacatgcagcgtggcattcgggtgctggcctacctgtttgccaaccagtttcccggcaatcccttcgcgggccagcccgccatgctggcctggatcgagcggatggtgggcttttggagccgtagccagagcatatcgggagcgttcgaccatctctatctgaacgagaacagttggatggccgcggcgttcaccctggtggacatggccggtgcctttgatcatgccggctcggcggtttcagcggaatgccggacgcgctggctcgagaccatgcgccgcgccgctgtccacctggtggagcgggacgaggagcacgctttcatcagcaaccatcgggctgccggtgcggcgggattgctggccgctcaccggttgatgggagatgagtcctttcgtcggcgcggccagtcgatcatggacgagatctaccggcaccagtcccccgagggctggtacgcggaatatggtggtgccgaccccggctatcagacccttgatactcattaccaggggctcttttatcgggaatgcggcgaggctcgggttttggactccgtctcggcgtccatcgagtttctgtcctacttcgctcagcctgacggcagcgtcggaggggaatacggcagcagggcctgtccccatttctttcccggcggcttcgaagtctttgcgtctcacctgccgctggccgaggccctggcgggccattgcgtcgccgggctcgcgctcggtaaatccgcaggcctgtccgagtccgattgccgcaacgagattcccatggcgacgagctatgtggtcgccatggaggcgatggaccgggacacatcgccccggaccgccataccgctgcccctttcccgcagattcgagcgcgcctggtcggaagccggtatgatggtccgcaacgacggatgccgctataccatcattggcgcgtccaagggggggaccctcaaggtattcgacctggccagcggcagcctggtccattcgtcctgcggctatgcggccaatgatgcaacgggacgtgacgtttccacccatctgtggactctcaaccccgactacactcatggattggctgtgggcgagaatccgcttgcgccggcacgcctcgtcaccgtcagggcgccgttcttccgctttcatcgccgccgtctgatgtcgccgctgaaactgcatctgttccggctgttcaacatgaccgccggacggattatcgccgtcaataattttgtacggcgggtattgatcgtcggccagtttatcagtggccgccatcgaagctctgcgtgcctgacgcgtgtcatcagtttcggccaagaaggcggaatctcaatctcggatcgctttgacgggctcggaggattcaccgggctgcgcgaatacgggttcctgtccactgtctacatggcatcagccaagtattttcgcccgcaggacatgagccacgagtgggtaagtgaagagcttgatcccgcaatcgagcgggtgaccgatgttccggcaccagaaggtgctcctcaatagcgttcgtaccaccgccagacctgcgtttccacggccggaggtcgtccaggaagcctggtctggcgagacattccaagatgcttgatcgtcccgagcgattgcgggattatccgcacgcattgaacgcccgaggtgggtttatgaaggttgtcattctgtgcggcggtttcgggacgcggatccgcgacgtggccgacgacattcccaagccgatgattcccatcgggaatctgcccatcgtctggcacatcatgaagagctactcggcggcgggtcacaaggacttcgtgctgtgcctgggttataagagccacgcggtgaagcagttcttcctgaactacgacatccacggcggcgacttcaccatcgcgctgggagccgagaagcagatcacccatcacggcgaagtgcgccacgacgactggagcgtcaccctggccgagaccgggctgaacgccatgaccggcgcccgcatcaggcggatcaggaagtatctgggcgacgacgagaacttcctgctgacctatggcgacggggtttccgatgtggacctggacgctctgctggaattccacaagtcccacggcaagatcctgacggtgaccggcgtccatccgcccggccgcttcggcgagatcgagcacgccaacggtcaggttcagggcttcaacgagaagtcgcagaccacctcgggcatgatctcggggggctatttcgtctgccggcgcgagatcttcgattacctcgacgaccgcgaggatctggtgttcgaggtcggcccggtccgcgccctggtggcggcgggcgagatgatggtctacgaacatcacggcttctggcagtgcatggacacctaccgcgactggagtctgctgcgcgatctgtgggacagcggcaaggcgccctggaagtcgtgggaatgagcaagggctctccaatccttctgaccggcggcttcggctatctcggcggtcgtatcgcacggcacttgctggcccagggcaaaaaggtgcgcatcaccacaaggcgtggcccggagagctggcccgactgggccaaggacgccgaagtggtgcgtcttaagccctccgacgataccgccttgctggcggcctgccagggcgtgtcggccctggtccatctttcggccatgaacgaagtggattgcaccaccgatccggtgggcgcgctggaggccaacggcgtcgacacggtgcggctgctgcaggcggcgctgaaggccggtgtcgggcgcttcgtctatttctccaccgcccgggtctatggcgagccgctgatcgggcggatcgaggagagcatgatctgccgcccggtccacccctatggcatcagccacaaggtggccgaggattacatcctggccgagcacgccaagggccgcatccaggcggcctgtctgcggctgtccaatgccctgggcgcgccggccgatccgctgatcaaccgctggaccctggtggccaacgatctgtgtcgccaggcggcgtccaccggcaagatggtgctgaaaagcagcggcgtggcgctgcgcgatttcatccccatggccgaagtggcccgcgccgtccaggttctgctggaggtcgacgggcctaagttgggcgatggcatcttcaacctgggtgtgggccattcctcttccatccgcgatctggccgatctgatcctggctcgggccgaggcggtgctgggcacccgtccggtgctggagcgccccgatcccaagccgggcgaggtggccgatcccctggacttccgggtggacaggctggcggcggcgggctttgccgcgtcccgagatctggcgcccgagatcgatcaaaccctgattttgtgccgcaaggcctttggctgacggagtttcttccatgcgcgtcctggttaccggtcataacggctatatcggccccgtgatgttgcgggtgctgcaggcggccggtcacgattgcgtcggtctcgacaccgactacttcgtgggctgcgagttcgaggcggccagggcgccctgcccggaactcaaggtcgacatccgcgacgtggagccgaagcatctggaaggcttcgacgctatcgtccatctggccgccctgtccaacgaccccatgggcgacataaacgacgactggacctacgacatcaacctgcgggccaccatcaagctggcggaatacgccaaggccgccggcgtaaagcgcttcgtctacgcctcgtcgtgctccatctacggctcgtcgggcatcgccggctttgtcgacgagacggcgcccttcgcgccgctgaccgcctatgccatcagcaaggtgaagtgcgaggaggccctggccgccctggccgggccgggcttctcgcccacctatatgcgcaacgccacggcgttcggcgccagcccccggctgcgcgtcgacatcgtcttgaacaatctgtgcgcctgggcggtgaccaccggcaagatcaacatcatgagcgacggcagcccctggcgccccgtggtccacatcgaggacatcagccgcgccgtcgccgccgtgctggccgcccccgtcgaagtggtgcacgatcagggcttcaacgtcggcctgaacagcgaaaactaccaggtgcgcgacatcgccggcttcgtcagggcggtggtgcccgaggccgaggtcacctatgccggcggcaacaatcccgatccgcgctcctaccgggtcagcttcgacaaatacgccaaggcctttcccgactttcccctgacgtggacggtggcggccggcgcccgcgagctggtggacgcctaccgcgcccacggcctgaccctggacgagttccagggacggcgctatatccgcctcaagcagatcaagcacctgatcgacaccggcctggtggacgacagcctgcgctggacgaagtaataacggcgtgactcctgatggggctcccgccccggccccggttggaggcgatgcctccaaacctccctttgattcataaatacgaagagggtttggggcatggccccaaatgggttcgggcgatagcccgatacggtcaccccaggacaaggaagtgcccatgtcttcgaagattcacggcctcaacatcatcccgctgcgcaagatccccgacgagcgcggcacgatcatgcacatgctccgggccgacgcgccccatttcgacaagttcggcgaggtctatttcgccaccgcctatcccggcgtgatcaaggcctggcacctgcacaccaagcaggcccagaactattgctgcatccagggcatgatcaagctggtctgctacgacgaccgcgccgacagcccgaccaagggcgtgctgcaggaaatcgtcatgggcgatttgaactatgtgctggtgcagattccgccgctgctgatcaacggctggaagtgcatcgggacccagacggcactgctggccaattgcgccgacatgccccacgaccccaccgagatgaagcgcatcgatcccttcgacccggccattccctatgactgggcgttaaagcacggctgatgactccgcgcgtctccatcgtcattcccacctataatcaggcggattttctcaaggaatgcctggattcagtgctggcccagagcgtggccgactgggaatgcgtcgtggtcaacaatttctccgccgatcacacccgtgacgtggtcctggcctatggcgatccgcgcatccagctgatcgactttgccaaccagggcgtcatcgccgcctcgcgcaatgtcggtatccgggcagccaaggccgaatgggtggccttcctcgattccgatgatctgtgggagccggtcaagctggaactgtgcctggcggcggccaccgatcaggtggatctggtttcccaccccgagcacttcctgaaggacggggtcacgggcaacgtcaccgaagcggccccggccgaacggtgcggcttcgagcgtctggtgctggacggcaattgcctgtcgccatcggcggtgctggtgcgccggaccctgctggagcgggtcggtggtttttgcgaggaccgtgaggtcatcaccgccgaggacgcggatctgtggctgcgtcttgccgccttgggggcgcgcatgacctgtgtcgaccggcccctgggcttttaccgcctgcacggcgagcagaactccaagggcgtggcccggcatatggaggcctcgctgactgtgctggagcgccatcttcccgccctgccccaccggggtggctggcgggggcggcgtgcccgggcgcggatcatctacggtgcggcaaggaccgagcagaagctgggccggggccgggcggccctgtcgctgctggcccgttcggcccggctgtggccgttccagccgcgtctgctgccggcctttctcctgtgcctccgggctttgcccgggtcgtgaacgtgaattggttttgacccgcgcccgcgattgttccagtatcgcggcgcttttcagcccccatcggagccccggaccaccatgatcaaagtcggcgttatcggtttcggttactggggccccaatctcgtccgtaatttcgccacgtccgaccgctgcaagatggtggccgtggccgacctggattcaaagcgcctggctgcggccgagcgctcctatcccggcatccgcaccaccaccaatcccgccgatctgttcgcggcggccgatatcgacgcggtcgccatctccacgccggtgcaataccatttcgatctggccctggcggcgctgcaggccggcaagcatgtgctggtggaaaagcccatggcggcgtcggccgccgattgccgccgtctgatcgacgaggcggcgaagcgcaagctgaccctgatggtcgaccacaccttcatctatacccccgccgtgcagaagatgcgcgatctggtccagaccggcgagctgggcgagatttattattacgactcggtgcgggtcaatctgggcctgttccagcacgacgtgaacgtgctgtgggatctggcggtgcacgacctgtccatcatcgaatacgtgctgggcaaggtgccggtggcggtatcggccaccggcatcagccatgtgccgggcgcgccggagaacatcgcctacctcaccatgttcttcgaggattcgaccatcgcccacgtcaacgtcaactggctggccccggtcaaggtgcgccagaccctgatctcgggctcgaagaagatggtggtcttcaatgagctggagccctccgagaagatcaaggtctatgacaagggcatcgtgctcaacgatgaccaggaacagatcaataagttgatcgccggctaccgtaccggcgatatgtgggcaccgcagctggcgggaacagaggccctggccgccgaggtcaggcatttcgccgattgcatcgagaccggcacggcgccgctgactgatggcgagatgggctacaacgtggtcaaggtgctggaggccgcgtccaagtcgctggcccagcgcggcgcctcggtggccgtcgaacgctgagtttggagacgtacaaatgattccctttcttgacctcaaggcccagtaccgtcagatcaaggacgaggtcggcgccgccatcatgaaggtggtcgacagcggcgcctatgtgggcgccggtcccgagggcaagcccttcgaggcggaattcgccgcctattgcggcgtcgccgatgccgccggcgtcaattccggcaccacggcgctgcatctcgccctgctggccgccggcgtcaagccgggcgacgaggtgatcaccgtgggcgcgaccttcgtcgctaccacggcggcggttctttatgctaacgccaagccggtcttcgtcgacgtcgactccgccacctggaccatggacccggccaagatcgaggcggccgtcacgcccaggaccaaggccatcctgccggttcacctgcacggcctgatggccgacatggaccccatcatggctattgctgacaagcacggtcttaaggtggtcgaggactgcgcccaggcccatggtgccgaatacaaggggcgtcgggccggttccatcggccatgtgggctgcttcagcttctatcccggcaagaatctcggcgcctatggcgaaggcggcgccatcgtctccaacgatcccgagatcatgaagacggtgcgcatgctgcgcgactggggccaggccaagaagtacgaccacgtgctgaagggcttcaacgcccgcctggacgagatccaggccgccgtgctgcgggtcaagctccggtatatcgagggctggaccgagggccgccgcgccgtggccgcccgctatgaggccggtctgggcggtctgggcatcggaattcccaagccgcccgcccattgccgccacgtctaccacgtctacgctatccgcagcgccgaccgtgacgcgcttcaggccaagctgcaggaggccggcgtcgctactggtatccactacccggtgccggtccatctccagaccgcctatgccgatctgggctacaaggccggcgacctgccggtgaccgagcggatcgccagcgaatggctgtcgctgcccatgttcgccgagctcgaacccggccaggtggatgccgtgattgcggcggtgaagcaggctggcggctagggctggcgcttcaactcaccatgacggactctaggtgtcgctcgagcgtaggcggaagagcgtggcttcgcccgggcagttgaagcggacagggggaagtccggttcccacgccgcgtgaggtgtagccccacatgttttccaaccgccagaggcctgcggccagatgctggtgggtgtccagcgccgtgaagacggctttccctcccggcaggcagatttggccgccgtgggtgtgtccgcacagatagagggccgctccggcatgggcggcccgggtcgccagatccggggtgtgggcgaggacgatagtgaagccggtgacccgagtgtcaaaggcctcgatggcggcaggcgtgaagaagcggttgacgtcgtccaggcccaagacggtgatttccgcgccgtggcgatgcagggtcaggcggtcattgaccagggttgaaacaccatggtggcgaaattcctccgccatctgccagctatcgtggttgccaagaacggcgatcgtgccctccgtggcccgataggcctggagcaccggtgacagaatctccagtgtctgcgtcgccgatggttgtccacgggtctggtagtcccccgtgagtacggcgaggtcgacacggacgcctttgaggcatgcggcaagctccgcttccaggccggcaacatttcccacgtgcagatccgaaaggtgcaggatcgagaagccgtcaaaggccgtcggcagtcccgggcaaggaaggtccagatccagcagccgcacgcgccgggcgttttcccgtccgcgattccataggccggcaagacggagagccagtgcggtcagccattcgaaaccgacaagcagcgacgtggggcgtggccccagaatgctgcttcgtcccggaagggcttccatctgctggcgttcgcggcgccactgctcatgatccgcaggcatattcaaagcttccctccgtgcccgggcgtcgggaaagccccgagcggtcgaaagataagtgcacgtgctggcggcacggccccatactgggctattctgctccggtttgacgaagggattgttagacgagattgctcttgcggagattgacctgttgctgacccgctgtgccaagttccggttgggggtatggctcctgcctccatcatgaccgtccggctggtttcgccccgggataagccgaccctcagcgaggccggagaggggtgggtggccatagggggcgacgaggttgatctggacccgagccgccgcatcgagacggcgaccgccctggaagccgcgtttgccgccgtcattcccgactttctggccttgtgccggaacctgggcgccgatccctcggcggttctggctcacacgccctcggcggcggctaatgtctccgacctggggctgatgatggcctggagccgtctggtggagacttgggcgggcgaggggcgcaagaccgttctcgtttgcgccgacccctggttgtaccggcatctggcaggactgcccggcgtcaacgccgccccaccgccatcgctgcccggaccgcttccccgtctgcggggctttgccgcccgtctgcgctatggcctgcgggccgccctgggcgtgcgggcgaagcccaccaccccgcaggggcggtcatggctgttgtcttatgccaatccccaatcgggtccggacggcaccgacgcctatttcggcccgctgatgcgcgaacgggccgatctttgccggatgctgcacgtggattgcccgccggaggaggcccggcgcctgaacgggggcggccgaagcttcagtctccatcactggggatcggcgctttttgctctgaccggcttgcccttcgcccgctggattccgcgcaaggagatgctggacgggccctggggttggctggtgcggcgggcggcgacgggcgaggccgccaccgcccagggtgcggccatcgcctggcaaatccattgccagcggcgctggctggcggatgcgcacccccttgccgtggcatggccctgggaaaatcacggctgggagcgcgatttctgccgcgccgcccggggcctgggggtggcgagcgccggctatcagcattcctcggtggggcggttcgagctgaaccatcatgtggacgccaatcccgacggtcttgccagcctgcccgatcgggtgctgtgcaccggcgccgtgacccgcgacgccctgacccgctggggattgcccgaatcccgcagccgcgtggctggggcattgcgctatggcttcgcccgaggaccgcgctgggatagggacgccccgctgtttgtcgccttgcctggcgacatggccctggcggcccagatggtcggcgcggtgtcccgcgtggcgcctggcttggggcgcaagatcctgatccgtccccatcccgtctatgacgtagccgttcccgagacccacctggtgacgcgggcggccaccggtctcggcggacaggcggcggtgtcggcggtaatctacgccgccaccacggtgggcctggaggcggtgcttttcggcctgcccaccatccgcttcatcgccgccggttgcatcgcccatgatattctgccaaacaccgtgaatgtccccgccgccgatgaggccggattggctgccgccatcgaaagggccgagccgccgcccaccgtcgcgcgtgacgatgtctttgcccctgtggatcacgatgtgtggcgccaagcgctacccctgcccaaggccgcctcatgagcgcatcccgtttcgccccgccttcgcctcgccccgagatcgccgattccggcctgacccgccccgactgggtgggcaataaccctcgcgatccgggcaagctgtggctcgacaagaacgagaacaccgatccggcgatgatcgagctggtgcggtcggtcatcgcctcggttcctgccgacgcgggcttcacctatcccgacctggggccggtgtatcgcaagctggcccccatggtgggcgtgccgccccaatgcctgctgctgaccccggggtcggacggcgccatccgcgccgtgttcgaggcctatatcgcgccgggcgacaaggtgctgcacacggttcccaccttcgccatgtacggggtctatgcccgcatgtacggcgcccaggtgacggggctggaataccgtccctccaatgccgggccggtgctgcatgccgacgacgtcgtcgccgccatcgccacgtccaagcccaagctggtcggactgcccaatcccgacagccccaccggcacggtgttctcccaggccgatcttcgccgcatcatcgaggcggcgggagagggcggcgcgctgatcctcatcgacgaggcctattatcccttccacgccgagacggtgctgccctgggtgatggagtacccccatctggtggtctgccgctcaaccggcaaggcctggggcatggccggcgtccgcgtgggctatgcggcggcgcatcccgacgtggcggtgatgctgcacaaggttcgtgccatgtacgaggtcggcgcgctgtcggccgccgtgttcgagcgcatgctcgaccacgaggatgccatgcgggaatcggtggcgcggatcagcgccggcaaggcccatttcctggccgccatggacgaattaggcttccagaccctgaagggacagggcaatttcctgcatgtggccttcggggccagggccgaggcgatccatgccgccctggcgccgcaggtctattaccgcaaggatttcgccgagccctgcctcaagggcttctcgcgtttttccgccaccacggcggagctgttcaacccggtgattgaagccatccgggatgtggtcaagggagagggacagtcatgaagacggtcaaggttgcgctgatcggctgcggccgagtcgccgggcatcacctgcgctccatcgccaaggtggagggcggcgagatcgttgccgtctgcgatctggccgaggacaaggccaaggcctatggcgcggaatatggcattcccttcttcaccaactaccacaccatgctgcaatccatgcccgagatcgacgtggtggcgatcatcacgccgtcgggcatgcatttcgagcacggcatggacgtgctgacccgctacggcaagcacatcatcatggaaaagcccaccttcatgcggcccgagcagctgcacgtcgcctatgacgaggcggcgaagaagggcgcgaagattttccccgtcttccagaaccgccacaacaaggcggtgcggaaggtcaaggaggcgctgtccaacggcgaactgggcgacatccgcatcatgaacgtgcggctgcgctggtgccggccgcagcgctattacgacctgtcgccgtggcgcggcaccttcagccatgacggcggcgccatttccaaccagggcatccaccacgtggacctgctgcgcttcctgggcggcgaggtggacaaggtcagcgccaccatgcgcactctgggcgccgagatcgaggtggaggacaccgtggtctccaccttcacctatcccggcaaggcggtgggctcgctggaagtgaccactgcggcccggcccgacgatttcgaggcctcggtgtccatcgtcggctccaacggcctggcccaactgggcggctgggcggtcaacgaactgcaggtcttcacccccgatccctccgcctgcgccacctattcggaaaagatccccgacgcctacggcttcggccacaccacggtctacgccaatctggtggccgatctgaacggggtgcggcccttcgacgtgacccgcgaggattgcctggcctcactcaagctgtggcactcgttctaccgctcggacgaggccaatggcgcctggaccagtgtggattccgacgagcagtcgccccgcctgggccgcgccaacgacgccgtgtccaacctctaccgcacccccgcgccctgatcatgagcaagctgcgggtcggcatcgccgggtatggagtggtgggccagcgtcggcgccagttcatcgaccagcgtgacgacatggtcaccgtcgccgtctgcgaccgcaccttcaagggcgagggggtgctgcccgacggcctgcgtcactacaccaatgcccagcggctgatggaggcggagacgctggacgcgctgttcgtctgcctgaccaatgacgtggcggccgaggtgacctgcgccgggctggagcgggggctgcacgtcttctgcgagaagccgccgggacgagacgtggccgatatcgaacgggtgatcgcctgcgaggcccgccacccggggctgaagctcaaatacggcttcaaccaccgctatcatgactcggtgcgcgacgccctggcgctgctggcctcgggcgaactgggccgggtgctcaacatgcgcggcgtctacggcaagagccagttcatctcctatggggctcattccgactggcggacccagagggcggtggccggcggcggcattctgctggatcagggcatccacatggtggatctgatgcggctgttcggcgacgagttcgacgaggtcaaatccatcgtcaccaacgatttctggaagcacgatatcgaggataacgcctacgccctgatgcgctcgcggaccggcgtggtggccatgctccattccaccgccacccagtggcggcaccgcttcaatctggaaatcaccctggaaaagggggcgctgatcctatcgggcatcttgtcgggctccaagagctacggcgccgagaccctgacggtcgtctgggctgacggggatgacaacggcgaccccaaggaacagaccacccgctataaccgcgaccccagctgggccgacgagatcgccgaattcgccgacgcagttttgcgcggcggcgccgtcgtcgccgggtcgtccaatgacgccctggaaaccatgcggctggtttatcgcatctactgcgccgattccgcctggaaggcccgctggcatttaagcgacgagatttaaggagagagtccccatgacccgcatcatcggccttatcccagcccgcatggccgccagccgctttcccggcaagccgctctttcccatccttggtcgccccatgatcgagcacgtcttcgagcgtgccaagctgttcggccgctgggacgccctggccatttgcacctgcgacgaggaaatccgggccttcgcccagtccaagggctatccggtgatcatgacgtcggacaagcacaccagggcgctggaccgggtggccgaggcggcgaccaagtgcggcgtcgacgtggccgacagcgacatcgtgctgaacgttcagggcgacgagcccatgatgcatcccgacatgatcgccgccaccatcaagcccatggaggagcggtccgaggtgcgcggcaccatgctggccatggacatcgtcgacgaggcccagttccgcaatcccgacgcgctgaagatcatccacgacctgtcgggccgggtgctctatacctcgcgccagcccattccccattgcaagaccttcggtcccgagctggaagccaagcgcatctacggcatcttcggcttcaagtgggacttcctgaagctgttcaccgaactgccgcccagcccgctggagatcaaggaggcgtgcgattccaaccgcctctacgattacggccatcaccagcacatcgcgccctatcccttccgccccagcttctcggtggacagcccccacgacatcggcatcgtcgaggcggccatgaaggacgatccgctgtgggggacgtactaacgccatgacctccctggccggcaagctcgccctggtcaccggcggcacccgcgggatcggggccgccatcgccgcccgtctgctggccgatggggccaaggtgatggttaccggcacccgccccggcggtgaaggaccggcgggcagcggctatctggcggtggatttcgccgacgcggccgccaccacggcctttgccgaacaggcggccgggctgggggtggatatcctggtcaacaatgccgggatcaacaaggtcagccccttcgccgagatcgaccccgccgatttcgcccgcatccagcaggtcaacgtcaccgcgcccttcctgctggcccgcgccgtggtgcccggcatgcaggccaaggcctggggtcgcatcgtcaccgtcagctccatctggggccgcatctcgcgggccggacgtggcgcctattccgccagcaagttcgcggtggacggcttgaccgccgccctggccgccgaggtggcccagttcggcatcctggctaattgcgtggcgcccggcttcatcgataccgagctgacccggcaggtgctgggcgaggacggcatcaaggagctcaccgcccaggtcccggcccgccgcttggggcggccggaggagatcgccgccttcgtcgcctggctggccgggccggagaactcctatatcagcggtcagaatctggtcatcgacggaggcttcacccgtgtctgagtccatgaccatcgcgtctcacaaggggccgtaccacgtccagttcgacgagcaggggctggagcgcctgaacgccgccgttcccgccgacgcccatttcatcatcgatgcccgggtggccgagctttaccgcgagcgcatgggtgccatcctggcccaccactcggtgctgctgatcgaggccgtcgagcccaacaagtcgctggaatgctttcccgcctatgtccagcatctggtggccaagggcctgcgccgcgatcacctgctgatcgccatcggcggcggcatcatccaggacatcacctgtttcctggcagccaccatgctgcgcggcgtcaaatggcgattctaccccaccaccctgctggcccagtgcgattcctgcatcggctccaagtccagcatcaattgcggcgacgccaagaacatcctgggcaccttcacgccacccaacgaggtggtgattgccaccaccttcctcgacaccctggacccgcgcgaggtgcgctctgggatcggcgagatgctgaaggtccacgccatcagcggacccgaggacttcaccgccctggcgagccggtatgaccggctgttcaccgagcgcgacgccatgatcgccaccatccgccgctcgctggagatcaagaagagctatatcgaggtcgacgagttcgaccaggggccgcgcctggtgttcaacctgggccattccttcggccacgccatcgaggcggccaccgatttcgccgtgccccatggcatcgccgtcagcatgggtatggacatggcgaactggaccagctggcatctgggaatcggtaccgaggcccatttccgcaccggccacggggtgctggccaagaactacgccggataccaggccacgccagtgccgctggaccgcttcctggcggcgctggccaaggacaagaagaacaccgggtcgggcagcgtcaccctgatcctgcccgacaaggagggcagggtgttccggggcgtccacgccgccgacgagacgttccggggcatctgtgcccgctatctggcggaaggccgctcatgaccgacaccaccacccgcgtggccgtggcatcgcggtcgttttccaagcacccggtgctgcgggccgagcttcaggcccgctacgccaacgtcaccttcaacgatgccggcctttccttgagcggcgacgatctggtggccttcctgttgggccacgacaaggccgtcaccgccctggaaaagctggacgaagccgtgctgtcgcgccttcccgatctcaaggtggtgggcaagtacggcgtcggcctcgacatgatcgatctggccgccatgagccggctgggcaagcggctgggctggaccggcggcgtcaaccggcgctcggtgtccgaactggtgatcgccttcgccatcgccctgctgcgccacatcccccagggcaacgccctgatccgcgacggcggctggcgccagttgatgggccgccagctgagcgagcgcaccgtgggcatcgttggctgcggccatatcggcaaggatctgtcgcgcctgctgaaagccttcggctgccgggtgctggcccacgatatccgggacttccccgaattctacgccgccaccggggtggagaagatggatctggagcccctgctggccgaagccgacatcgtcaccttgcatctgccctttgacgcctccaccaggaatattctgtcggccgagcgcctggcgctgatgcgttccgatgcgatcctgatcaacgcggcgcgcggtggtctggtggacgaggcggcgctccgggtcatgctggcaaccggccgtctggcggcggcggccttcgacgtcttcgccaccgagccgcccgaggaccgggcgctgatcgaattgcccaattttctctgcaccccccatgtgggcggttcggcggaggaggcggttctggccatgggccgcgccgccatcgccgggctggacgaggcccgcgatccgttggactacaaggggcagggttgatgcgtgcattggtgccggcggcccgggatcgagacatattcaccgaatcggtgacgaccgtgaccgcgatctggcggtacggatgttagccgtgccggctgagggccgcctgattctgaccacagtgccggatgactttgatccggctcatgatgtggctcttggcccgtggtgctttgccggagtggagaaccggcatcccggctgggaagacctacccttcgctgatccgttcccaacgcaggacagttgggtggaggccgataggaacgcccgccgtctggctagcgccctcgtcgcaccctgggcggctcgcctcaatcggcggcacagccgggaatacggattgggcttctggcgcgttcttctgctgaagtggttggccatctgcgtgccccccctgtggcagcgctactgccaagtcgacgcagtcatccgattgcatggcgagcggcggctaagggtggagttgtgtgccgactgtgaccgggattggcacatcctccagacggctgggctcatcgagagcttcgctgacccggcgatcgatttccgcattgtttcgaagattgtgtctcacctggctccaccagcctgggtgcagaccattgtggccgctccgccatggcccagccagccagaagccagatccccactggaaaccatgtccgtgttgcgccgcctgttagggcgcctgccggtggatagtgttccgggggcctcggcccttcaccggatattgctgtcggcatgggttgccatgctgcctcgccggacggcccggtgtttctaccgggcggaagatgaaggggctttcgccctgtttccccccgtatttctggaaattctgggccgggtacttgagcaaatgctgccggcgaccctgcgaggggggttctctgacctggagaggtatgcgcgggatttctcctatcatcccggacgcctgctggtcgacgctctggataccgaggaggattatcggcgagtcgtgcaggccatggcgcacgagaagggtgagcggctggtcagcgtgcagcacggcggggtctacggcacggcccgcgccatgatggtgggggccgaaaccgaatatccctatcacgctttcctgacctggggatggacggcgcaggaggactatgccggaaaatttgttcccgcgccgtcgcctgatctgtcggccgtggttgggcgtcatcacgaacggcagggtcgtttggtgatggtcggaaccgcgatgctcgtacacggcatacggctaggctggctacccaagccacagcactatctgagctaccgcagattcaagctggatttcctggccggtctcgacccggttgtcaggggcgccgtccactaccgtccttaccgtcgcaagccggaggtcctcaaggatgaggactacctgcgcgccgtttatcccaatctattgctggttgacggcaatttgaacgacgccctgctgtcctgtcgtctggtcgtgattgaccatcccgtcacgaccatgcttgccgccatggccgccgacacgccgacggtgctcctgtggcaggcggaggcttggccgctgtcccgccaagccgagcctctgtttcagcgcctgcgcgacgtgggcatacttcaccatgatcccgcaacggccgccgcccatatcaacaaggtgtggtcgaatgttcaggggtggtggcggaattcagaggtgcaggcggcacgacgtcagttcgccgaacaatacgcccaagcgtcgcgcgcgtggtggtgggactggttgaaggtcctggcccggctataggggcaatagctagcccgacttttaaatctaaccgcaggccgccagcgcccgcaccacccgcaatcccaggtccaggggactggggccgggtcggggcgtgcgtactgcctgggcaaacaggcgaacggcccgcgccaggggcatctcggaatcgatggccagagtatcgcctttgcccgcgggccagccgaagtcgggacaggacggatggcgggtgagcttgtcggcggccgtgtcgtcgaataacagcacgccccgctctccgtgaacagcgaatcggcgggccttgtccatggtgttgcacaggcgtatccttgcctcgattccatcgaaggccagggttagggtgacgtcgccggaatcgccgccctccttctcgccccgcgccgcccaggcggcggagacgcggttcggatcgcggcccatgagatccagggtctgggcgatgtcatgggcgccccagtcccacagcatgggaaccccgcccttgcgataggggccgtgattgccggcttcggaacgaatggcccggatggggccgatggaggtcagggcggccttcagcgccgtccaggcgggattgaacaactgggtatgttccacccagaccatggccccggcttcgcgcgcggcacgggcgatggcgtcggcctcgcccaggtccagggtcaggggcttctcaaccaggaccgcttttccggccgcgatggccgccaaagtgatctcggcatggctggcgggtggtgtggagacgatcaccgcttccacctccggggcggcaatggaggtacgccagtgggcgtccaccacgcagccgggcggtgccagaacatggctttccgggttggagctggccagacgcaccaacgccgcgcccggcaggccggcgatggtgcggatatagttgcggccccagcgccccgccccgatcagggcgaggcggacagggtcactgctcgccggtatagacaccgtcggcccaggtcaggaagcggcgcaggccttcgttgaggtcgacgctgggctcgaatttgagctgcagcttggccttgcgaatgtcggggcagcggcggttgggctcgtcggcgggataggaatccggatactcgatcacattgtgggccaccggcttgccgatcacctcggaaatgcggttgaccagatcgaccatggagatttccggcttgggattgccgatattgtaggcctcgccaggcacgccgcgcaggatgaccagcaggaagccgaccatggcgtcggtgatgtagcagaaggtccgcgtctggttgcccgagccgtagacgttgagcggatggccgcccttgatgcggttggcgaaattaggcagcacccggtagtcggtctcctgcatgccagggccgaagacgttgaacgggcggatggtgttggtcttggtgccgtgctcgccgtggaagatgtagcacagcgtctcgccgacgcgcttggactcgtcatagcaggcccgcggtccctggcacgacacatggccgcgatagctttccggggtggggacgtgcttggggtccgggtcgccgtaaatctcggaggacgagaagaaggtgaagcgggcgttgtgctcctgagccagttccagcatgcggcgcgtgccggtgatggccacttccagcgtcgccagcggatgggcacggtaatagaacgggctggcgataccggccgcatggatgacgtagtcgagcgagcccttccacttcagcggctgaatgacgtcgtgctggatgaactcggtgtgaggatactcggcgacattggcgccttccttgcccgccgtgatcaggttgtcggcggcgaccagcttaaccggcttcttcaggatgtgctggttgagatgggcgaagatctccatgaaatagcggccaagaaagccgcgaccgccagtcagcagcacggttttgccggcgaagtcctgggcggtgtcgcccaggcgctcgcagatttcagcgatatcggacttcagcagaaactcggccatcagacgacctcgaccttgggaatggggatgatgaatttgccgccgccagagcggaaggctgcgttcttgtcgatgatggccttggcgaagttccaggccaggatcaccaggtaatcgggcttcttcgcgaagccgtcggccgacgacaccaccggaatatgcatgccgggcgagtacaggccctgcttcagggggctgtcgtcgatgatgaagtcgaccagttctggcccgataccgaaatgatacatcaaggtggtggccttggctggcgcgccgaaagcaccgacgcgcttgcccgcagccttgagggatttcagcacggcgttcagttcggcgcccagcgcctcgatatcggctgcgaatttggcgagtgtggcagccctgtccaggcccagcctttcctccagcgccaccgcctcggccaccgaggcaccaaccgcgtgggggccgcccttcaactgggcgatgccgcgcaatgatccgccatgcgagcccacccgaatggcctccaccagttccatgcctttggcggcgaagaagcggatcagcggcttgaccgagtgatagtccagatgttcgtggtagatggtatcgaacagcgtgttctcgaacacgtccactaggtaggacacctcgaaaacgaacacgccgctggggctcagaaggccgcggaccccatccaccacgccagacaggtcgtcgatatgggcgaagacgttgttggcggtgatcacctcggccttgccgtgggcggccgcgatctcggcccccttgtcggcgccgaagaagccgcagatggtgggaatgccgcgtgcggtcgcttcggccgagatttcctgggcgggatcaatgcccagcacccgcatgccggccttctggaagaaggacagcaaggtgccgtcgttggagccgatatccagcaccagaccacccgccaccggcttgaagcgctccatgacgaaggcggcgtaatcctcgaaatgcctcacgaagaccggcgaggtgcccgagacatagacgtagtgctcgaacaggacacgcgggtcgaccacgtccagcagctggacatgggcgcaatcctcgcagaagaacacgtcgaggggaaagcgctcctgctccctgtccagctccgaggccggcacgaaggcgttggccggcggcgtggggaccagcttgaccacctcggtcaggcgtttgccaccgcacaggcggcaggtggggcggcggtgatgctgggtgctcatgggcttacttgtcgcccggcttccaggaggtcagcccctcggtggccagcagatcgatgcgcaccacgtcggcctcgtaggcggcctggtcgcgggaattgcgcgacagtgtcaggaaggtgcaatcctcgggaaacaccatgccgtgatcgaccatgggcggcgtgaacatcatctcgcccgccttgacgatcatgcgggtgggttcctcggtgctgcccgtgggacggtgccagtattcgatggagcccgacaccacgtagcaatagtgccagtcggtcttgtggtagtggttggcgcgaagcgaacccttcttggactcgatcaggacggcactcttcatcagcctatccaccagcggctggatggtgccgcgggcgtcggtgaaggccttatccatcttgaccacccggtcgaaggctggccagctgagcttttcctcttcagtgaccgggtcgatgtcgtggtagtggtcgtgggacatgaaagacgtctcctagcggacgaagcgttcgcggatgatggtggcgaacacggcgatgatgtggtgggccttgatcttcttgccttcggcataggtgcggccatgatacgagatgggcgtctcgtagaacaccttgcccgcggccacggccttggaaagaatttcggcgtgctgctcccaaccggcggtgcgcagggcggtcccgtccaccagcgagcggcgatagcacaaatagcaggaatagatgtcgctgaaggtggtgttgttcaggacgttgaacaggaaggtgatcgcccagttgccgatcttgtgccagaaataaaatactctggtgtattctggcgcggcaaagcgtgatcccatcaccacgtcggcgccgaaatcgcgcacgggcttcaagaggcgggcataatcctcggggtcgtattccaggtccgcgtcctggaacagaacgaaatcgccggtggccacaccgagcccggcccttacagccgcacccttgccgccgttggcctggtgcaccacctgatcgtaaagctcgggccgcgcgtcgagaatctcgcgggtacggtccttggagccatcgttgacaaccacgatttccagttcgatgccgggaacgcgctgggcgcgaacccgctcgaggacacccgcaatggtggcttcttcattgtaggccgggacgaggacggtgatccgggtaggcttcgaattcggcacgggtctgctattcgtgtcaagagtactgtgcaacctgacttctagcccggatggctcattgtggcaagcgagatggcccgacccaccgcggccaagggcgatgaccggcgcggtgttgccacgcgaccgcgatgatgcgatctgtcagggcgatcgggcggcggctaggccgcattcccggggatcctttgccgtggtggcgaccaaggggcgccgaccatagcacaggctgacatgtcgggagccggccgggacggcgatggcggtctggactccattggcctcggtaaaggggagctccctgccatcggcccaggcgcgaaagtgccgggtggcaagggcgttgaccatcagcacgcctccctcgggcgcatccaggtccacctcgaagccgttgcgcaccagatcaaagcggccgaccgtcatggaggcatgggcttcggcttttccaagagccatcgcatgggccgcgttgagtacggcgacgcgggcaggagccgccgccgcgacctcggcgagaaagccggcgctgccggcggcgctgctggtggtctgcagcgcggctgccgcccagaccctaggcagccgcccgggcagggcgtagatatgcatctttcccaggtcaaagattcgcgaccacctgtcgcggtaatattccatgggggatacgccggagcggctgggcttttccaactgcggacggtcaggcccgtccagcagcacaagcccttgccccgtgacgggcagggcgctgaccagatagcccacgttggcggcggcgagaaggggcagcgataccatctcttcgacatgaacaacgccgccccgcacactcgcccagtcatagccgattcgggggtctgtgggatcacggggattcacgccattgacccaatatcggaaaaagcgagggtccatcaaattcagccaagcatcgaaatagggcaggttataggccaatacgactccgggctcgggctgaagataggaggcgcgcaaagacaccacccgggcggggtccgaggcattgaaccatgtgggattcttcaggtttgaaacgtgatagtgagcttggcctgaacgataaaagagattgatcatctgaaagccgacattccatcccaggatggcaaaggcgccgaccagggccagggcggcgggtaggctctcccctcggccgatgacccaggggaccaggccgtaaccgcgccgcttccaggcgataatggcttgtgccgccaccagggtgaccgtaccggtcacgccgaaggtgaaatagcgggttccagagttgcggatgccggccaacccgatctcagtccagggaaacagcaagaaaccggcgatgaagaagaccggcagaatcatggtgatgagggctcgcgggacttgcctcggggcggcaatggcgagaaaggcgagcgagagggcaatttctagccccagcggccacgccgtgttggtgaacatcgacagatagccgacgatggtgccgtggattacgtccaacgcttccgtggaaacggaggactgatcgctcccccgcatgctttctcccatggtctggagcattgcgtagatggattcgctccaattgacgccgatgacgataccggccagggcgatccctgcgaacgggcgccagtcatagcgcttggtcaggatcatcgtggcgaccacggcgatggagatggccggcgccccttcggtgggaaccatccacagccccgccatgacggcataggccaaggcgccgccccaccaccatctgcggccgagccgcccgaccaggaggtaaacaccgatgggaatcagggacagggtcatcccggtgctataggtcaccaggatcatgcggaaccagaagaccgtgccgaaagccgccagggccagcgagggccggcggtccagtccgccgagacggcgggccagaaggtagtttccggcaaagccgaagacacaggtcagggccttgtgaacggcgatggcgatccacagcgggaaatgggccatcagaaagcgttcgggcgagatcagctctccgccgatcaggaacgatcccttgagatcggcgccggcgcccagcagatgggagtactggccgccatcggcgaagttggccacgtaatagtgaaagggaaccagcagatcgccctcgtcatccatccagagataggaggatgggccgaacgccatgtacgggaggaggaagatcaggacccagacgaccgggaagatctttgacgaactcagccagccggagccggctctggacgggcgcaggccgtagatcgccaccagcgacaggatgacggcgagaatgattggcagctcgctcttcatatggaagtctcctggcgcgtttctgagtccatcccggcccggagcaactctgctgtcgcctcggccacgcgttcaaccgtcaggtcaagcatcagacagtcagggcggcggtggttgaaatcgggggcgtggcagatgtcttcgaacgagcgcgggccgcgcaccgaggcgcaacgggggccgaaggggccgtagaacacctctgacgacgggccgaacagccccagcgtgggcaggcccgaggcggcggccatgtgcatcaggccggaatcgttgcccacatacaggctggcccgcttgagacaggcgtggagggtggccagatccaccttgccgatcaggtcgaggcgccgctcgaccggaacggcctcgatcaacggctggatggccgggcgctcggcctcggcgccgaacagcgcgaccttggctccggccaagattcctccttcgccggtcaggcgggtcgccaactgggcgaaacgctcggcgggccactgcttgggagcccaattggccccgggacccagcgccagaatggggccgtcgcccatcagcctggcggcctcgtcgtcctgggcgggggtggaccacagcaccggcgccagcggcctgtcgaggcccagcagtgccgagagatgcagcagccggtgcttgggctcccacgacgacttgatgatgcggcgcttcagtgtcggcaccagccagcccaggcccgacccgcgcaggtcgatcacctgatgccagaaggttccggcggtctgccgccacaggtcgatccagtggccggcgcgcttgcgcttgaccatgggaatgaccctctcgacaaagggggccgaggcgaacaatcccgccgctgccgcgccacaggccaccgtgaagcgggcctgggggtactgcccggcgagatgggccagcaatccggtggacagcaccgcatcaccgatgcggctggcggtgatgaacaggatgcgcaaagactacagccgccacaggcggagtgactgcgggatatccatgccgcgccacatgcccttgacgtcggccaccagcccgtcgggacggaccagggtggtgaagctctcgcctgaaaaggccacatagggctgatgcggcacggcgcccagcaggcagtcataaccggcggcgccgtccaggctgggcatcagggtctcggaatattcgtgctccgcctcggccgggtcggcgaaggggtcgtgaacatctaccgagtgcccccgggcgcgaagggcgcggatcacgtcgaccaccttggaattcctgaggtcggggacgttttccttgaaggtcaggcccaggaccagaatgcgcgacggaccggaaagctgggctgacacccgttccgcgatccactcgcccatgccgtcgttgatgcgccgccccgacaggatgatctcggggtgatggccgttgtcctgggcgcattgggccagatagaagggatcgacgccgatgcagtggccgcccaccagacccggcttgaaattgaggaagttccacttggtggacgaggcgtccagaacgtcgtagaccgaaatccccagcttctggaagatcatggtgatttcgttgatgaaggcgatgttgatgtcgcgttgggcgttctcgatcaccttggcggcctcggccacccggatcgaggcggcggggaacacgccccccgtggtcaccgagccgtagatccgggccagcagtgccgtcacctcgggggtctggccggcgatcactttggtgatgcggtccacggtgtgttcgcggtcgccgggattgatgcgctcggggctgtagcccaggaagaagtcggtgccgcatttgagccccgagtacttttccagctcggggccgcagatatcctcggtgacgccgggatagacggtgctttcaaacaccacgaccgcgccgttcttcatggccctgcccaccgtgcggcaggccgacagcaccggcttgaggtcggggtaattgccgctgtccaccggggtgggcaccgtgacgatgtagacgtcctggccagcgatgtcgtcggccttggccgacaggcgcatggtgctggctcgcagacgggcggtctccacctcgccggtacggtccaggcccttgtgcagctcggcgacgcggccctggtcgatgtcgaacccgatggtggggaagtggcgggcgatggccacggccagcggcaggccgacatagcccaggccgatgacggcgatccgcgacgacggggtggacatgaacaaggctcctcaaacacttggcaaagggggttgtggacaaagccgcccccccgcgtcaatcaaaagatggcctgcctcatccctcgatggtgccggcctcggccgagccccggcctgcaaccaccagttccagaacccggatgaatagatcggcctgacgctggcgggtatgggacgaggccgcttccaggctggcggcggccagggtcttgcgctctgcggcatcgtcggccagacggcgggcggcggcggccaggccgtccggatcggcggcaggtacgaacagtccggcccggtcggcctcgacgatgtgcgaggcctcgccccttggcgccaccagcagcagcggcaggcccatgcccatggcctcgaacatcttggaggggatcacctcggcgaaggcgggcgaatccttgagatggatcagcgccacgtcgcacagcgaccacacggcgggcatgcgctccttgggctggggcgggccgaacaccacgttggcgagaccgcgccgggcggcctcgtccttcagcatctggcgctcggcgccgttgccaaccagcaggaagcggatatggggcgctgtgtccttcaggcgcagggcggcgtccaggacattgatcaggccgtgggccatgccgtgggtgcccacatagccgatgacgaatttgtccttcaggccccattcggcctccagcgcctcgtcacgcggccggggggcatagcggggcaggtcgaccccgttgatcaccacggcgatcttttccgccgggatgcgccgggcgatcaggtcggccttgaaggcccgggtcagcgccaccacggcggccgagcggcgatagaggaacagctccagcgcctcgatggcgcggatcaccgggctgtccttcatggcgcccacggcggtgatggagcgcggccacagatcgcccagctcgaacacgaagggcacgcgacgcaccgccgccagcgcccagccacccacggcggcgaagaattgcggactggtggagaccaccacgtcgggcctggcctcgaacagcccggcgataaaggccgacaccatgaaggacaggaagtcgaggatgcgcttggcgaagccctcgttgggggcgatgtaggtcttgacccgcaccacccggatgccgtcgaccaccgagatctggcgccagtcgttgcgccagccctcgaacagcctgccgccggggaaattgggggccgaagtcagcaccgtgacctgatgtcctgccttgatccaataagccgcccgctccgaaaccctggtggcggcggcattggtttccggcggatagttctcggtcaggaagaggatgcgcatgccagcagcttctcgatcaccgcgacggcctggggcaggtcgtcgaccacgtgatcggccttggtgccttcgacgaatttcgggccgtggccggtgcgcaccaggatgctgacggctcccacggcatggcccagttccacatccacttccttgtcgccgatcatgaaggcctgggccgggtcgaaatggtggtcggccaccgcctgctccaccatgccgggcagcggcttgcggcaggtgcagtcgtcggcggggccatgggggcagaggtaaagcccgtccaccatggcgccctcggcttccagcagggtgtagaggcggtcgtgaatctgatcgagacgctccaggtcgaaatagccccgcgcgattcccgactggttggtgaccacggcaacgcccaggcccagcctgttcaggcgacggatggcgcgcccgacgccgggataaagctccaactggtcgggatcggacaggtagtgcttttcgacgttgatggtgccgtcacggtcgatgaggacgaagcgcttcatgaaaccttctccaaacgcgccgcgaagaatgcatccatgccgccctgcgaggcaagatggcagggcagggtgcgcagatcgccctcgggggtgatcagttcggccagcccgccaacctcctcggggcggatggggacgcgcctgagcggcgcgcctccggccagcagggcggcgatctgctccgggccttcctccgcctccagcgaacaggtgcagtagaccagggtgccgcccggcttcagcatgggaatggccgcctgcagcaggcgggcctggacgccggccagcttcatcacctcggccgggttcttgtgccgggccacgtccgggtggcggcgcagggtgccggtggccgagcacggggcatccagcaggatggcgtcgaagggggcgggcggcgtccaggcgccggcatcggcttccaccaccttggccttcaggcccaggcgcttcaggttggcggtaaagcgcaccagccgcttggccgagcggtcgagcgcggtgagatcggctccggcgacggccagttgcagcgctttgccccccggcgcggcgcacagatcggccacagccttgcccctgacgtcgcccagcaggcgggcgggcagggcggcggcggcgtcctgaatccaccaggctccgtcgtcgaagccgggcagggcggcgaccgagccgccggcggcgcggcgcagcgatccggtgggcaggaccgaagcctccagccgctcggcccacagggcggaatcggcggccaccgtgatgtccaccggcgcctcgatcagatgggcggcggcgatggcgtgggcgccgtcctcgccataggccttgacccaagagcgccacagccattccggcgtgttgagcagcccggcatcctgggcggccgccagatcgcggccctcgcggtccaggcggcgcagcaccgcgttcagcagcttggcgaaaccggccagcttggagcccttgaccagatccacggtggtggagatggcggcatggggcgccacgtccaggaacagcaactggcagattcctaagcgcagcgcgtgttcggccccggcggcgccggcccgcatgggcttgtccaggcaatgctcgatcagggtgtcgatctggcccagccgtctcagcgtggtgcccagcagcatgcgcacgaagccgcgatcgcggtcttccaaccgggataggcgggaatcgtccagcacgtcgtcgagcaatcggcccttgtccagcaccatggacagcaggtcgacggcgatggcgcgcggtgaggtggaggaggctcgcttcatggggcaacccttaccccatccatgcccgtcgagcaaacggaagccggttccatcggatgccgaggcggcgtgtcccagcgatggtggctcactcggcaatcttgcccttgaaataggcgatggtcttttccaggccctgctccagcgccaccttgggctcccagtcgttcagcacggccttggcctgagtgatgtcgggtttgcgctgcatggggtcgtcggcgggcagcggcttgtagatgatctcggacttggcgccagtcattcggaccaccagttcggccaactggcggatggtcatctcgcgcgggttgcccaggttgatggggccggtgatgtcgtcggggctgttcatcaggcggatgaagccttcgatcaggtcatccacatagcagaacgaacgggtctggctgccgtcgccgtagagcgtgatgggctggccctgcagcgcctgcatgatgaaattggacaccacgcggccatcgtcgggatgcatgcgcgggccataggtgttgaagatgcgcgccaccttgatgcgcaggctgtgctggcgccagtaatcgaagaacagcgtctcggcgcagcgcttgccctcgtcgtagcaggcgcgcgggccgatgggattgacgttgccgcgatagctttccggctggggatgcacatccggatcgccatacacctcggaggtggaggactggaagatcttcgcgcccaccctttttgccaggcccagcatgttgatggcgccgtgcaccgaggtcttggtggtctgcaccgggtcgcgctggtagtggatgggggacgccgggcaggccagattgaaaatctcgtccacttccacatacagcgggaaggtgacgtcgtggcgcatcatctcgaaatagggattgtccagcagatgcgcgatgttggccttggtgccggtgaagaagttgtcgacgcacagcacgtcgcagccttccgccagcagccgctcgcagaggtgggagccgaggaagccggcgccgcccgtgaccagaacccgcttgcgatcatacttcatggcacccgttcccccgctttctgcgtcttgaaacttcgtaggacaaaggccccacgaaagcaagctaccccaaccggccgatgcgctcgaactcggccgccgcctgatcccagtgccagcttcgctgtttcaccaggcaggccagatgtagacgccgccacagggcgtcgtcgctgaggatggccacagcatgactgacaaaggtttcctcatccttcacgcaatagccggtttctccctcgatcacccgttctctcatgcaggcgatgtcctgcagcacggcgggcacacccatggcctgggcctcggccaccgccgaacagaaggtctcgccgatatcgccgcgatagagcagggcgcgggcggcggccagttcatccaccagctgggtcttggggacggggccgcgcagcaccacgtcgtgggccgccatggcggcggccttgttcagcaccacgcccatgcggtcggccttggcagcgccggcggcgccataggtggcggtgccggcgaagacgtgcagttcggcgttgggcacggccgggcggatgcgtcgctcccacaggtccagcagccagtccaggctccgcatgggattggaggtgaacaccacccggggcggcggcggctcggtgcgcggcgtggcgtggcagaacaggtcggtcaggccgtatggcacggtttcccggccgccggccatggcgaaggacggataggtggaggcgtggctggccccggagaacacgatcaccggcaggcgcagcgccagcttccactgatagcgccacttcagcaggtagccggcgggattgtgaatccagaagatggtgcgcctggccttggggcacaggcggatcagcttgtcgccgcgattggcgatgtagagatcggcgctgtcgggcacgccctgggacagggggcgccaggtgacgcccctgtggacccgttccgcctcgcacttgttgcagaccagcacctcgtggccgcgcgccgccagggcgttggccatctcgatgaacgaagtctcggccccgcccagcggccgttcctccaatgtggcgccgtcgaagctgatgccgtcgtcggtcatgacgatgcgggccatgggcgctattccttctcgtacttggctttgaagtgggacagcaggggataaagcccggcgcagatggcgatgatcaggccatagccgccttcccgccagccgccccgccgcacatagcatttgaagaagcgagagaacagccggcggatattggaggcggtggagccccaggtttcgccacggtcgcgcaggtcgcgggccttggcggtggaataggaatccaggcgccggatcatgtccgagatgttcttgtccacgtagtggtccagccggttgaccagcatggggcctttcctgccccgccagaccagcgaggggtggacgcggtcgcggccccaggtcttggcggccttgcggaacaggccgggataggcggccttgccgtaagaggcgccccagccgtggcggaccagacggtcgccgatgtgattgtccaccaggatctcgtgccagtcgaagggcgacgtggcgatgacccggcggatttcctcggccaaagcgggggggacgtgctcgtcggcatccacctccagcacccattcggtgtcgcaggcggcaatgccggtgttgcggcggtcgccctccaggtcccagcgcccctcgacgatgcgggctccgaaggccagggcgatgtccttgctgccgtcggtgcacttgtcgagcaccaccaccacctggtcggcgaagcgcagcttctccaggcaggcgggcaggcgcttttcctcgttgcagatgaccacgagggccgtcagggaggtcatgcgccgacacccttgaagcggggcaggaagcgcttgcgggcgtgggcctgggccgtgcggtagacctccagggtctggttcatgcggttgtcgaagcgcatgtccttctccgccagttgcctcgcggcggcggccatgcgggcggtggcttcgtggtcggtcatgacgcgggccatggcctcggcgaggcgaacggggtcggcggggggaaccagcagtcccgtccggccgtcaaagacgatttccggaacgccgcccacattgctggccaccaccggcttgcccacggcgaaggcctggacggcgacccggggctgggcttcggtcagcgagggaatcaccaccgcgtcgcccatctgcatcagttccgacacgtcgtcgcgatagccggtgaacaccacctggccactcagcccggcagcctccaactgcgtgtgcaggccgcgctcgtaatcggcgcattcggcggtggccgagccgacgatcgccagcatgggggacaggcccttgtccttgagcagggccagggcggccagcagatggtcctggcccttgtcggggcggatcatgccgacgcagacccaggcataggcttcggcgggaatgttcagcgcggcgcgcaggcgggcgcgggtggccaccggatcgggcaggtcgaagaagcgctcgtccgcccagccgccgatggagaccgagcgcttggcatcggccagcccgacctccagcaattggctccgggtgcattcggccacggtgatcagccagtccgcacccagccgccattgagcgcggcgaatcatgccgcccttgagcggctggttgacgtggcgcgagcgcactaccgccaccagatccaggcaggcggcggcggttttggcgtcgcgggtgacgtgggtgtcaaccacctcgacacgtttttcgatcagcagccggcgaaagccgcgcacggtggcgggcttccacgggcggtcgaagtcgaagtcgatcaccggcagcccggcggcctcggcccgcttgtaggattcgccgtccgacggcgaggccagccacacatcgtggccatgggccttcagccagcgcacctgttccatggtgcggtgttccatgccgccccaattgcgtcccggaatggtgtggagaatgcgcaaggatttcctctctcagaccaggatgaagcgtcgccaccatgcctgaggcgggggcggcggcagggtgacgcagcgcaagcggcgggcttggaggccctccagcagcagccgcagcatggcgatggtgacggcgggcttgaactgggcgcccgggcgctcgttgatgggctggtcgtgcatcaggaggatgccgccgggcaggcggggatcggccagcaggcgctccacatccctacggcactcggtttccacgtcctcgggcgcggcgcagcgggttgaggtcatgtggtcctcggtgctggggccccaatggaccagggcgcagcccggcttccacgcggccaaggcccggtggatgcgcgccgagcgccgcccgccgttatagggcaggcgcaccagatagggctggggcgtcgggcggtggcgggccagcagggcttcgcagcgttccatgtcgtcgagcaggcgggaggtgggctcgcggtcgaggcgcacatggtcccagccatgggcgtagacggcgtggccgcgcctgaccgtctcggccaacagggcgtcctgcgacaccgcgcggcagccgctcataaagaaggtggccttggcatcgaagcggtccagcaggtcgagcaaggccggcgtgctatcaggcatgggggcatcgtcgatggtgatcgccaccgtgcccctatcggccaagtgccgcatcatcggccgccacgcccccagtgaccaggaaatccgcaatcgctgtccgtccgcttgttgtggcgatcgaagtatcaggaatccgccatctcgaacagcctgatcatggggccgggcggcggagggtggcctggcggctgaatcgcttcagatccttggcgcccccgccctcggccacggcacgggccaagccgtcggggtcctgggcgatcagccccgaactgacctcgacgccatagctcagcaggcgctcggtcagcggcgcccccggccccaccagggccacccgggcgaagcgggccagatgcaagagatggggcgccgagcggttggccagggtcgacgcggtgatgatcaccgcctcggcggcaggcagcagccactcggcggcctgttccggatattggccggggccgggcttgcggtcgacgatcttggcgccgggcaggcgctcggcgatgccgggaaaggcgccgatcaccacggtgccgccacccttgacgccaaagctttccaggccgttgccgcccggaagctcgaggtcgtagcgattgtaatgggcgttgcaggcggccatgcctaaggcctgatcgaaggcattggcggaatggaccagcccggccagggcctttagccccgcctggccccgtcggcccgcatcgggggcggcgttgcagcccggcgtgccgcgttccggcgtctgggccagtccgacgccggtcgcggtttccaccatggtccagttgagccccaccaccacccgcttgacggcgcaatcctccacgccgttggcgaggtcggcgtaaagccgccccggtccccaccagcgccacagcgccgccagggagggggcgatcagctcggtctggccgccggtgaactccgtccattcctcgatcagcacgccgggcacggcggtcagcaccggcacgccctcggccacggcggccagcatgtcgccggccagcccttcgccttccatctcggacttggagaacttgttgatgaacagcaggtcggcatggctttcgatggcgcggcgcaccgagcccgaggcctcggccagggcctgggaatccaggatgcaggccttggacgccttgcccaggctttggccgatggacagcttccggcccgtatcgatctcggtcaccgtcatgtcggtcttgcggcccgtctcgtcgcggagcgtgtcctgcagcagcccacccaggcgaaagccccgcgccgccagctgggcggcgaattcggccagcaaggcctcgggcggcttgcccggcgggtagatgaccgcgccgatggcgggctggctggattgcggggcggaaaccatgggggcactcctaagccttttgccgatgtcttgaccaacgccaagactcgtttttaacgcaggcagcatatatatcattagagcaagcccccgccgaggggcatggaggatgcgtcatgatcgatccgtttggacgcaaggtcagttatctgcgcgtgtcggtcaccgaccgctgcgatctgcgctgcgtctattgcatggccgaggacatgcatttcctgcccaaggccgacatcctgtcgctggaggaactggagcggctgtgcggcgctttcgtccgttccggcgtgcgcaagctgcgccttaccggcggcgagcccctggtccggcgcaacatcatgagcctgatcaccaacctgggccgtctggtcaagtcgggcgagctggacgagctgacgctgaccaccaacgccacccagcttgccaagcatgccgacggcctggcggcggccggggtcaagcgcctcaacgtctcgctggacagcctggaccccgccaagttcgaggccatcacccgctggggcaagctggatcaggtcttggacggaatcatggccgccaaggccgccggtctggcggtcaagatcaacacggtggcgctgaagggcggcaacgaggacgagcacgagcatctggtggaatggtgcgggcgccacggcttcgatctcaccttcatcgagaccatgcccatgggcgacatccattccgaccgcaccgagcagtatctgccgctctccctggtgcggagccggctggaacagcggttcaccctgtccgagatcgattaccgcaccggcggcccggcccgctatgtgcgcgtcgccgagaccggcgggcgcatcggcttcatcacccccatgacccacaatttctgcgagacctgcaaccgcgtgcgggtgacctgcaccggaacgctgtacatgtgcctgggccaggaggacgccgccgatctgcgcactcccctgcgggccagcgagggcgaccagttgctggaggccgccattgccgaggccatctccagaaagcccaagggccacgacttcattatcgatcgcgattcccgccccgccgtcagccgccacatgagcgtcaccggcggctgatgccgctggcctccgccagggcgcggacctcggccacctcgtcggggtgggccgcggcgtaggccgttcgctcggaccggatgcggttgatcacggtctcgacattgtccgaggtcagccggatgccgaaggacgggtcgtccttgcccgagatgatgcgctccaggatcagatttcccgccgccttggtgaaatgggagccgtcccagtaccagtgcatgcgggtcgccgggtcgcgggggatgtcctcggtggtgatggcgttgaagccgctgaaatcccacagctcggcatggctttcggccaccgtcgccgccaggtcgcgcttccactgctcccaggcgggcagcagcccggcccccgccttggcttccagcaccttggcgtggatgggggtgacgaacagcaccacccgggtcttgccgttatcgaaggcggagaggatgcgccgcaggtcttccatccgctcgggcgcgtagcgaaacccgccataggttcgttcagagccaggcaaggacagttgcaggtgcagcacgctgtccatctcggcgcggtggtcgaagcctttcttgcgtgcgccgatgtcataggtgccgtccttggcgaaggactggcgaagacccttgaccgaactgaacaggacccagccggaatcgtcgaaagattgcagcgacagcaggcgacggacatagaccggccaggcagaggccccggcaaagcccgagcggtcgaaatcgccgctggtccacacctggctgccgaacaacagcaggtcgaggccgatgaccaccagcttgggcgactggtgacgggcggcataatcgatggcatgggacagctcgacgatattggtggccgacagcgaggcgttgaaggccagggcaccactcagggccggcgattgcgggtccaggcccatttcaccgcgtgaactgccgtaaagcaggacgtcgaatttggtgtggccgagaatcagcgccttgttgacccgtccgccgtcacgccgcagcgtcttctggtcattgaagcctttgatgtcgttccagcggaagctggcatagggatcgacgataaagttgaaggccgcgcccatcgccaacagcagcacgacccccaccagcagggtgaggagaaaacggaggtttgtcaggggggcgggctggctcatgtcagaactggtaatagaggaattcgctggttcgccacagggtcatggcggaacaggccagcatggcggccagggtccaggcccagccggtggtggggcgccacgccagtcgatccggccgttcgaccggctccagtcccggcccggtggcgctcatgatctgctggctgttgggggcggcgacgcagaccgccatcaggaccagcgacaggaccagcccgtcccacgccaccttgaccgcgccgcccgacaggccgttcagccccgccatgcccttcagcacgatcagcgcggcatcgaaattgacggcgcggaagaacacccaggcgaccacgaccaggacctgggtcagaatccagccggcaacgacttcccctcgccccggcacggcgggacggatggcccgccacgcgtggttgcccaccagcatcagcccatgtaggcagccccacgcgacgaaggtccaggcggccccgtgccacaatccgcccagcgtcatgacgagcatcaggttgacgtggcgccgcaccgggccgcatcgcccgccgcccagcgggaaatacaggtagtcgcgcagaaagcgcgacagggtcatatgccagcgccgccagaactcgatgatgctggtggccttgtagggcgagttgaaattgaccggcagatcgatgccgaacagccgcgccagtcccagcgccatgtcggaatagcccgagaagtcgaaatagatctgcaccgtgtaggccagggcgcattgccaggcggccagcaggcccaggtcctgaccggcgccggcagcggaaaaaccgggtgagacataggacgccacccaatcggcgatcaccgccttcttgaacaggccgatggcgaacagggacagtccggccaccagattctcactcgtcgcgcagtccctgcggggctggcggaactggggcatcatctccttgtggtggatgatggggccggcgatcagatgggggaagaaggtgacgaacagggtgtagctcagcgcgtcggcgtctcggaccagattacgccggacatccaccagataggcgatctgggtgaaggtgaagaacgatacgccgagcggcagttccagccgctgcgaggtgatcatcaaccccagcagcggcgcgacggattctgcgaagaagcgctcgtacttgaagatgccgagaaaggccaggttggcagcgacgcccagcgccaggatcgctccgccccagcgcgtgtcgcggctgcgcgcgatggccagcccgaacaggaagttcccgacgatggaggcggccagcggccaggcataggccggattccaccaggcatagaagacgatggaggccagcgtcagaaacgccatggccggacgccatcccatccgccggattccgaagaacccggccaggaccaggggcagaaaggcgaacaggaaaggcgccgaattgaacagcatcaggccgacgtgccggcggcccgttcggcgatgaaggcgtccaggtcttccggcgtgcccaggccgtgcatggcggtctggggaatctcccagacgccgatccttgccccggccttgatggcgtagttatagaccggacaggtatagaactcgttgttgacccggtcgttggcggcgatcatggcttcggcggcccggcggaaggcccgcgccgacttgaagtagtagatgccgaccgtggcccattcgctgatggggtccttttctgccacccgctccaccagcccgtcgtcccgcagcttggcataggaccatttggggtggggctcggacttgaagaccatgatggagccgtccaggtcgcgggccagcgcgtcgtccagcatggccgtgacgccgccatccacgaactggtcggaattggccaccaggatgggggcgtccggatccatcttgtcataggccgccagcagggtgcaggcggtgccctcggtcagtccgtccagcaggtggatgtccagattgcccgcggccttcagctcggccaccacgccgggctcggcggcgcaatgggcggcgcgggcgatcagcaaggtggaggcaccggcataggccacgttgtcgatgacgtggtggatcatggggcggcccagcacgtcgatgaacggcttgggcttggcatagcccgcctgggcgaagcgcgagccctcgccggccatggggatgacgatgatcggcttgctggtcattggtcgagcggcgaggtctggaagtggtcgaggaagtgcgacacgtcctcggggatgcccagtggatggaactcggcattggggatcttgtgctggccgacgcgggcgccttccaggatcagctggttgatggaaggcacgatgaagaactggttgttgaccagggtgttcttcagcagcgacttctcggcgccgcgcacgaacatgccgccgttgcggtagtagtacgcgcccacggtggcgtggttgctgatggggttcttctcggcggtttccaccaccatgccgtcctcgtcggtgcgcacgaaggaccagcgcggatgcatggaggtgaaggtgacgatgcccacgtccaggtcgcgggcgcggaagtcgtcaagcgccggctgaatgccccgggccgtccactgatcgccgttgcataccagcagcggcgcctcgcggtcgatgtggtcgacggccagcagggcggtgcacagggcgccgccggtgggcttctcggtctggacgatggtgcagccgggcgccagcagcttgagcaccgagtccaggtggaattcctggcggtcggcggcgttggtgacgaaaatgaagcggtggtcgccggcgggccgggacgagcggatggcgtattccaccatggggtggcccagcacctcgatcagcggctttgggaacttctggcccatctcgtggaagggccgcgccgagccggcgatgggcatgaggatctggatcatgacgcggcctccgccagacggatgcgttcgcggatgttccagtaggtcacctcggaaggatcggcgacgcgcagcacatgggcgcccgacgcggtagccgcctgcacgccgtactcattgtcctcgacgatcaccgtctcgaccggcgccacgcccaggcgctgcatggccgagacgtagatgtcgggatcgggcttgggccgggcgcaatcctgattggacagggtgatgtcgaaatactccagtaagcccgactggcccagcatcatgtcgcaggtctcgcggatggagttggtgcacaccgccagcttgtagctctcggccttcaggcgcgacaccgcatattcgatgtggaacaccgggaagcaatgggtggcgatcaactgcttggtatagacctgcttcaactcgttgatgacgccggccagccccttgggaaagccccggtgctcgtgcagataggccagcttcttgcgggtcggcaggccgtcgaaggtggtcaggtgctcttcgcggccgatctcgtagccgaacaggcgcagcgcctgattgagcgcctcccaatgccactcgcgggcatccaccaggacgccgtcgaggtcgaacagaacggcgcggatggggctcacctcaggaactcctgcaattgggcgggaaggtcggtgcagaccatcacgcggtcgtcgtggcgaaaatgccgggccaggtcccagatgggagcgtgatcgcgccggtgcagttcgcccgagaccagggcaacccgcttgccggcgtccagatgggcctggacatcggcggaggtgatccattcgcgctccagctcgtccagccacaccccggcggactgggcgtaataggcgggcgagggctcggcatcggaatgccgcgtgaaggtggtcaggcccaggcgcagatagtggcgcatgtcgggcaccgacatgtcgaagaagaagtagtccgaggcccggcccgccaccagcggcgccatggcctcggccaggccgtcggccttgacgttgagcgccagcacccgttcgggcgaggccagctccatccattcggcccagcattggtccagggcaggggaatcggcgccgggcatgtcgtgggagatcaccacgcctcccagccggtcgcgcaggtcggtctcgatgccgaacccggcccgcagcgcctgaccgagcgaggaggggcggttctgttcggccttttgcttccaggctccacgatgagccagaatccgcgcgcccatgggacctcggaattgggattgacctttatgccgccatcgcggcaaatcgacgggcggaaaaaccgctgggtttggatagcaaattccctcttcccacgcaacccgaccgtcccctgacttaaagccgccaccgtgatcatcgacagtatcgaaagcctcgtcaaagccaagcattgccgcgatctggatgcggtcgaggtgcgtacggcgcggttcaagtgccgcaacctgctgccccacgccttgaaatacgccttgtgggctctccggcccggcggaaccctggtggtgcaggacgacggccccgctttggccgagacctgggagatgcctttcgcccaggtgcggcgtctggtgttcaaggtgctgggcggtgacgccgccctggtcgagatgaagcccgaggccttccgtttcaccttcacccgcacccgcccgttgccggcgcccggctggtcggcggggctgatcttttccggcaacgacgcggaactgcccgccttcacccgctgcatggaggggctgcatgcccagccggaactgaccggcgaggcgggcgagatcctggtctgcggcccgaggcgcgacctggccttcatggcgccctggccccaggcccgctatgtggagttcgagacgccccccggcccgcgcttcctgatctcggccaagaagaacttcctggccacccagttccgcttcgaccgggtgctgatcctgcatgcgcgcatcagcctcgatcccggctgtctggccgccctgccgcgcgaattcgacgtggtgacaccggcggtcttcgccacggtccaggggcgccgttgcgcctatctcgactacgtcatctcggacgccaccgatcccaaccgcatggcgacgcgtttcaacgtgcccattgattacccccggaaccgctatcatgcgtttcttgacaggggtgaaccctatatcgacggcgggctgttcgcggcccggcgcgatatcctgctgtcggtgccgctggacggcaatctgggctggtccgagggagaggattccgactggtgccgccgggtgcggaccagcggctttctggtggatctggccgttgaagccacggcgaccaccgatgccaacaagatgggtcgttcggtagcgcccagcgcctgggatctgatccgccgccccattcggcggcccttgcgggcgctgtcggcgtggggccgttacataggcaagcgtctgcagggagaacgttgatggcagttgtctacagcttggccggcaagcgggtctgggtggccggtcatcggggcatggccggctccgccatcgtgcgccgtctggagcgcgaggattgccgggtgctgaccgtcgggcatgccgagctggatttgcgcgatcaagccgccaccctggcctggatggaggccaaccggccccaggcggtgtttttcgccgccggaaccgtgggaggcattttggccaattccacccgtccggccgagtttctctacgacaatctggccatgatcaccaatgcggtgtcggcctcgcgccagaccggggtggagaagctgctgtatctggggtcgtcgtgcatctatccccgcctagccgcccagcccatggcggaggatgcgctgctgaccggcccgctggagcccaccaacgagtggtacgccatcgccaagatcgccgggatcaagctgtgtcaggccttccggcggcaatggggctgcgacttcatttccgccatgccgaccaacctttatgggccgggggacaattaccaccccgagcacagccatgtggtcgccgccctgatccgccgcgcccacgaggcccgggatgcgggggcgcccgaactggtgatctggggaaccggcacgccgctgcgggaattcctggccgccgacgatctggccgatgcctgcgtgttcctgatgaaggcctattccgccgaggcgcatgtgaatgtcgggacgggaatcgagcattccatccgccaattggccgagaccgtggccaaggtcgtcgactaccgtgggcgtttggtgtttgatgtctccaagcccgacggatctccgcgcaagctgatggatgtgggccggatgaccgaattgggctggaaagcccccaccgggctggaggacggcctgcgcgccgcctatgcctggtacgtggccaatctgggaaagtagacgtcccccgatggcccccaccgatccggggaagtcatgatcttttcctccatcgctttcgtcgccgccgagaccgaggccgccaaggcggccctggcccggctggagcagcgctacccccatgtggaccccggcgaggccgatgtcatcatcgccctgggcggcgacggcttcatgctggaaacgctgcaccgtttcgtcgatcgccgggtgcccatctacggcatgaaccggggcagcgtcggcttcctgatgaacgtctaccgcgagcacgggctgatcgagcggctgtccaaggcggaagaggtgattctccacccgctgcgcatgaaggcccgcaccgcctcgggcgaggaggtggaggccctggccatcaacgaggtgtcgctgctgcgcgagacccgtcaggcggccaagctgcgcatccgcatcgacggcaagatccgcatggacgagctgatctgcgacggcatcctgctgtccactccggcgggcagcaccgcctataacctgtcggcccacgggccgatcatccccttgggcgccggcatcgcggcgctgacccccatctccgccttccggccccggcgctggcgcggcgccctgctgccccacaccgccaaggtggtgttcgagattctggaagcgggcaagcggccggtcagcgccgtggccgactacaccgaggcccgcgacgtggtcgaggtcgaggtgcgcgaggaccgcacctgcgatctggtcatgctgttcgaccccgagcacaatctggaggagcgcatcatcaccgagcagttcctgccgtgatgatcaggctgcgatcctgggccgtggccctcgggcttggcggcgtgggagggagtctgttcgccgccctcgacctgccgctgccctggatgctgggggccttgacggcggtcaccctggcgtcgctcggcgggctgcggcccgaaatccccgcttccatgcgcagcgtgatgatcgccgtgctcggcctgatgctgggcagcgccttctcgccggatctgctggcgcgcatcgggcggtggagcgattccctgctggtcctgaccctggccaccctggccagcggcctgctggtcaccttctacctacggcgcacgtcgaaaatgagccgggtcaccgcctttttcgcggcggcgccggggggcatcaacgagatggtcctgaccggcggggccatgggcggggacgagcgtaccatcgcgctctcccattcgctccgcatcctgctgatcgtcttcaccgtgccgttcggctaccgcctgatcgcccacgtccattcggtccccatggccgagagcatggggcggctggccgatctgggcggcatggatgcgctggtcatgctgggctcggctgtggccggagcggcactggcccgtctggcgcgcctgccggcctggatgctgaccggccccatgctgagcagcgccggcctgcatctggccgggctgaccgcctttcgcccgcccgccgaactggtggtgctggcccagctggtgaccggcgcgtccatcggttgccgctttcgcggcctgtcctggtcggacatggcggggatggcccgtccggccatgggcgctaccgccatcatgctggtactgtcggcgggagccgccggattgctggcggcgggcgggcattcgtccttcggggtgctgctgctggccttcgtgccgggcggcatcgccgagatgtgtctggtggcgctggctttgggccaggacgtggccttcgtctccacccatcacgtggtgcgggtggtgatggtgatcatgctggcgccgcccatcttcaaattgctggaacgcagggagagccgccgatgaggaccatcgattccagggaactggccgacctgaccgccgccgccgccgaacgaccgcggcggcggctcaatatcaacctgcaccaggatgcggccgattcggtccagcgcatggtcatcgccttcgagcccgagacctatatccgcccccaccgccatccggcacagttcgagactttcatcctgctgcgcggccggggcaccttgctgtccttcgccgatgacggacgggtcgagacgctcgtcgagctggccgaggaccgggtgcgcgtggtggaaattccgcccggcacctggcactcgctggtctcgcgggccgagggaactctggtggtcgaggtcaagcccggcccctaccagcccacggctgaggccgactttgccgcctgggctccgcccgagggtcacaaggatacggatcgctgccgcgattggatggcacagtgcacgatcggagagcggtacactcaccgagcgtagatttgctgcgccgcagcaaagggtgacacgggaatgttacattccgcccaggcaatccgctttccattgcaggaatctatgccatactctgcccgttgccgcgctgtgatgggggcgtcacttccgtgagactgcgtcgtcgcgcgtggaacaggcaatgtaaggaggggtcgatgaagaagtggattgcttcgactgttgtcgctttggcggcgctgttcgcgtttggtcaggaagcccgtgccgatggcggcgtggtcctgggtgtgctgacctgcagcaagaccggaaccggtaccacctatgtggttcattccagcactccggtgagctgtgagtacaacggtgtcggcggcccgtccaagtacaccggcaccagcggcatcctgttcggcatcgatctcgagatcgagcacatggccggcatgggctatctggtgatcggcgggaccatgaccaacaaggacagcctggccggctattatgtcggtgccaaggcctcggtgaccgtgggcctcggcctcgccgcgcaggccggtctggccggcgtcggcaacgacatcgtcctggttccggtcggcctgggtggccagatcggcatcggcgccaccgccggtatctcctacgcgaacctgaagggcggcaagtaagcctctcccgtcacggtgacgtgaaagggcgggacgccacggcgtcccgcccttcttatttgagccgtgccaggatctctgccgcgaacagggacagggtgtcgtcgcgggcgcccatcaccacgatgcggtcgccgggccgggccatctccaccagggcatcgccgcaggcggcgcgctcgggcacggccagggcgcggcggccccgcgccgtgatggcctcggccaggtgggcgctggtcaccgaacggtccaccgtgccgccgaaatagaccgggtcgggcatgaccagcacgtcgtcgggccccagcctctcggcgaagcaggcgacgaattcgtccttcatcaggcgcagcggcccgaagccgtggggctggaacatgaccagcagacggccgggccagtcgtgcagggtggccagggtggcggagatcttgtcggggttgtgggcgaagtcgtcgatgaccgtgacgccgcccttggtgccgacggtttccaggcggcggcgcacgccggagaactcgcccagcgccgttgccgcgtcctccagtccaagtccggcggccagggcgcccgccagggccgccagggcgttggagacgttgtggcggccgggcaccagcagcttgaccggcatggtcttgccatccctggtccgcgccgtgaaggcgatgccgtccggcgccgggctgacgttctcggcccaaagatcggcgcccgggtcctccaggctgtaggtcaccacccggtcggcgggcagggtggcggccagggccgccgtctcgccgttgtccaggttcagcaccgccacccgcgccttggcggtgaagtcggcgaacaggcggcgcagctcgtccatggacttgtggtccagggcgatgttgttcaccagggcgatccggggggcgtagttggcgatggagccgtcgctttcgtccacctcggccacgaaggccgggccgtcgcccaccagggcgctggaaaagggcgaatcggggcggacgaagttcttcatcaccgcgccgttcatcaccgtcggcctgcggccgcagcgttccagaatccagcccagcatgccggtggtggtggacttgccactggtgccggcgatgccgatgggcagctccgaggcattgaacagccgggccagcaattgcggccgggtcagcatgggcgccttcagggcgcgggccgccaccacgtcgggcacggtgtcttccaccgccgccgaggtgaccagcacctgggccgggtcggtgatgccgctgccgtcctgggggaacaggcggatgcccagtccctgcaggtattcgaacttgggcgccagccgtccctggtccagggagcggtcggaaccggccaccttgtggccgcgggcgtggacgatcagcgccaggggcagcatgccgctgccgccgatgccgcagaagaaatagggggtgtcgtgctccatggccggaggctacaattcgcggcctttgacggcaaggggatcgacggaagatgggtgcaggcagaaccaggatcggcatcgtcgcaccgggctcggccatcgacgacggcatcgccggacgggtctccgccctggcctccggcctttatcccgacgggcgggtggaactggtcttccatccccaatgcttcgagaggcagggccatttcgccggcagcgacgaggtccgccgcgccgtcttcgcccaattcgccaatgacgacagcctggacgccctgtggttcgcccgcggcggctatggcgcctgccggctgatcgagggattgctgcccctgctgggagagggcgcccggcgcaaggtctacatgggctattccgacgggggctcgctgctcggcgccctgtatggtcggggctttcaccatctggcccatggacccatgccggtggacatcatccgtcccggcggcgaggcggcggtggtccgtgccctgggctttctggccgagcgcaaacccgaggcgctggagccctcgctgtcgcccgaagtgccgacggcggcctttaatctgaccatcctggcgcatctgctgggcacgccctggcagcccgacctggcgggtcatgtgctgatggtcgaggaagtgtcggaatacatgtaccgcatcgaccgggacctgttccaggtgaccagcaatccggcgctccgccacgtggcggggctgaagctggggcgctgctccgacattccgcccaacgagcccgatttcggccagaccgaggaggaggtggcgcgagcctggtgcggacgggccggcatcgcctatctgggccgcgccgatatcggccatgacgtgggcaacaaggtggtgcccttcggcttgtggcgagtctgatgcccgaccccgatgaacccggttcgtcgggggtgggtcaggcccaaggggccgcgccgctcatgcggcggcgcccggcgcctgagggcggtcccggggattgctcgcaatcacggggacatgagcagaaacaggcaccatagtgcatgtccgggctagccaatccggaacggccgtgcttcactgaatgccgggcaacaggaattcgggcacgggacacatggtcgaacaggcggaattcgccgttctcgccagacggttgggggatcgggtcaagggctttcgcgcccggcgcggcatgtcgcgcaaggacctgtccagccatgccggcatttccgagcgctacctcgcccagctggaaggcggacaggccaatgtcagcgtcaatatcctgtggctgctggcccaggccatggatacgcccatcaccgaactgatcgaggcggaggccgaggccagccatcccgacctgcccctggccaagaagttcctcgaccagctgactccggaccagcaatccgaggcctatgtcctgctgcgccagaacttcaagcgcggcctgaagctcaagcgccgggtggccttgatcggcttacgcggcgcgggcaagaccaccctgggcgaggcggtggccgggcgctttgccgcccccttccggcgcatcacctcgatgatcgagcagatggccggcatggacatgaccgagatcctgctgtccaccggccagaagggctatcgcaagctggaatattccgccttggaaaacacgctggaagcccagcccaccatggtgctcgaggccggcggctccctggtgtcagagccccgcaccttcgaactgctgctgcaatcgtgcttcaccatctgggtccaagcctcgcccgaggaccatatgcgccgggtcatgggccagggcgacctgcgccccatcgccggacagcagatggccgccatggaagacctgaaggccatcctggaggcgcgccgtcacctctatggccgggccgatgcggtgatcaacacctcgggccgcagcatcgcggatagcgtcgaggagatgtcgcggctgtgcgccccgcatctggggctgtgaatttgtcgccgcctgcactatagtgcattggatgagcgctacctcccgcacccaccgccgcctcggccccgccgccgcctcgcccgtctccgtggccgaaattgtcgccgtgctgcccgaagacttccgccgccgggatctgctgatcgagaatctgcacgggctgcaggacggattcggcggcctgtatcgccaccatctggcagccctggccgaggaaatgcgcctcagccccgccgaagtgcaggaaacggccagcttctacgcccatttccgcctgctcgatgaccatgaggcggcgccggcggccgtgctgcgccgctgcaccggtccggcctgctccatgcgtccgctcgacctgggtgccctgcccgacggggtgatggtcgaagacgtgccctgcaccggcctgtgcgaccatgcccccgtcgccctggctggcaaggtgccggtgcgccgggccgatgccgccaaggtggccagggctctggccgagccttactctccgccaatgccgtccggagagtcctttcccgttctcgaccgctgcctgtcgggcgagctgccccgtgatgaggcgctgaccgagctggagcgggcgggcctgcgcggcatgggcggggccggttttcccaccgcccgcaaatggcgcagtgtcgccgcccagcccggtccccggctggtggtggtcaatgccgacgagggcgagcccggcaccttcaaggaccgctggttcctggaaaaccatgccgcccaagtgctggaaggcgccctgatcgccgcctgggcggtggaggccgacgaggtctatctctatctgcgcgacgagtatgcagacctgcataaaggcttggcgacgctgatccgggacctgcccggcgacatcaccatccatctgcgccggggggcgggggcctatgtctgcggcgaggaatcggcgctgatcgaaagcctggagggcaagcgcggcctgccgcgccagcgcccgccctatgtggcggaggtggggctgttcgggcgccccaccctggtcaataatgtcgagaccctgtactgggtcagccgccttctggccgaaggcgccgagctgttcggcaacgaaggccgcaacggccatcacggtcttcgcacctattccgtctccggaagagtcaaggagccgggggtgaagatcgcccccaacggcattaccgtctccgaactgatcgacgagttctgcggcggcatggaggacggccatgtgctggccgcctatttgccgggcggcgcctcgggcggctttctgccggcccggctgcagccgcccctggccttcggcgccatcgaggagcatggcggcttcatcggttcggcggcggtggtggtgttctcccaggccgacgacttgcgggcggtggccctgaacctggcccgcttcttcgcccatgaaagctgtggccagtgcacgccctgccgggtgggcaccgccaaatcggtgggcttgctggccggtcccgcctgggatcgcgatctgctggacgatctggccggggtgatgcgcgacgcttccatctgcggcctggggcaggcggcgcccaatgtgtggcagagcctgtttcggcacttccccgaggtggtgacatgatccgcttcaccctggacggccaagaggtcgaggcggccgagggcgagaccatctggcaggtgtccaagcgcctgggaaccaccattccccatctctgccataccgaccggccgggcttcgagcccgaaggcaattgccgggcctgcgtggtggagatcaagggcgaacgggccctggcggcatcgtgccgccgccgcccgacgccgggcatggtggtggaggcggccaacggacgcaccgccaaggcgcggcgcatggtgttcgagctgctgctggccgaccatgcctcgcccgatccggactcggcctttctgggctgggccggggcgctgggcgtgacggccagccgtttcgcccccagcgcggcgcccgtgcgccccgatacctcccatccggccatggcggtgcgcctggacgcctgcatccactgcacgctctgtctgcgcgcctgccgcgaggtgcaggtcaatgacgtgatcggcatgagcggccggggggcggacagccgcatcaccttcgacttcgcccaatccatgggggccagttcctgcgtcggctgcggcgaatgcgtccaggcctgccccaccggcgcgctgctgcccgccgccgggccggtcagggtggagcgcagcgtcgacagcctgtgcccctattgcggcgtgggctgtcaggtcacctatcacgtggcgggcggcgacatcgtcggggcaaagggccgggacggggaggccaaccaccagcgcctgtgcgtcaagggtcggttcggcttcgattattcccgccatccccagcgcctgacggtgccgctgatccgcaaggagggggcgcccaaggaaccgcttgaccccgccgatcccttcacccatttccgccccgcatcctgggacgaggcgctggatgcggcggcggccgggctgaagcgtctgcccgcttcggcgctggccgggctgggctcggccaagggctccaacgaggaggcctatctgttccagaagctggtgcgcaccggctttaagtccaacaacgtcgaccattgtacccggctgtgccacgcctcctcggtggcggcgctgctggaaggcatcggctcgggggcggtgaccgcgccggtggccgaggtggccaacgccgaggtgatcgtcctgatcggcgccaacccgtccgccaaccatccggtggcggccagcttcatcaagaacgcggtgaagggcggcgcccaactggtgatcctcgatccccgggggcaggcgctgacccgcttcgccagccatcacctcaagttcaacaacggcaccgacgtggccctgctgaacgccatgctccacgtcatcgtcgccgaggagctttacgaccgcgatttcgtgcaggcccgcaccaccgggttcgccgaactggcccagcatctgaagtcctatgctcccgaggccatggcgcccctgtgcggcatcgatgccggaaccatccgcgtggtggcgaggctttatgcccgcgccgcctcggccatgatcctgtggggcatgggggtgtcgcagcacagccacggcaccgacaattcccgctgcctgatcgccctggccctgctgtgcggccatgtggggcggccgggcagcggcctgcatccgttacgaggtcaaaacaatgtccagggcgcctcggacgcgggcctgattcccatgatgctgcccgattacgggcgggtggggctcgacgccgtccgtcagcgcttcgaagcgggctggggcgtcgagcttgatcccgattccggtcttaccgtggtcgaaatgatggacgccgcccaggccgggatcattcgcggcctgtatgtggaaggcgagaatccggccatgtccgaccccgatctcgcccatgcccgccaggccctggccgggctggagcatctggtggtacaggatattttcctaaccgaaaccgccatgctggccgacgtggtgctgcccgcctcgtccttcttcgagaagaccggcagcttcaccaataccgaccgccacatccagatgggacgccaggtgatcgacccgcccggcgaggcgcggagcgatctgtggatcatcaccgaaatggggcgacgcctgggccttccctggacctatgacgggccgaaggcggtgttcgacgagatgtgcgggctgatgggttcgctgtccggcatcacctgggagcggctggagagcgagggcggcatcaccacgccggccggcaaggccatcctgttcggcgatgtcttccccaccggcgacggcaaggcgcgcctcgtcccggcctcgggcctcgccccggccgagaaccccgatgccgactatcccttcctgctgtccaccggccgggtgctggaacactggcatacggggtccatgacccggcgttccgacgtgctggaccggctgcaaggcttgccggcggtcaatgtcagccccggggacatggcccgcctgggactggccgagggcgcccgggtgcggctggaaagccgccgtggcgccgtcgaggcggcggcggtggccgattcccgcctgtcgccgggggcgctgttcctgcccttctgcttcaccgaggcggcggccaatctcctgaccaatccggcgctggacccggtggccaagattcccgagctgaaggtctcggcggtgcggctgttgccttgctctgaataggagcgtcatcccgacgaccatcgggaggagggatcccatcctgggcgggctggtccgaatcgactccgccctgccaggcggagatccctcggcttggcctcgggatgacatgtggcatgatgtcatgcattataatgcttctaaggcggtgggtgcggtgatatagttccggacattcacccctatgggagcgatgatccgtgtccaagaccgcattcaaggcgctggtggcgcaggtaacttcttccatcgccgggctgccggtggatgcctccctgggcgaggtgctgaacacgcgctttcccgagggcggcgaggtgttcaaagccatcgaattcgcctgccatgccgccattgccgagggctggatgtgcgagaacgagcacggcggcatccgctacggccgggtcgccgaggccgacggccagctttccggcttttccatcgacgtggtccacatgaaggacgtggccgggccgcgtcatcgccatcccctgggcgaaatcgacatgatcatgcccatcgatccggacgccaaattcgacggcgcgccgcgtggctggctggtctatggcccggacagcgtccaccgtcccaccctgaccgagggtgcggctttggtgctgtacctgctgcccgacgggcagatcgatttctcgcggcccaagtgagggccgagccatgtggcgcgaacatcagcacggcctgatcgatctgggcgaccagcgtttggaatatcgctgggtccatccccctgcgccggggcggccgaccctggttttcctgcacgagggcctgggttcggtggggatctggcgggattttcccgaccgggtggccgaggccaccggctgcggggcgttcatctactcccgcgccggctatggccgctcgacgcccgtcgatctgccgcgtccgctgacctacatgcatcgcgagggcctggacgtcctgacccatctgctcgagcatctggatctggggccggtggtgctggtgggccattccgacggcgcctccatcgcgctgatccacgccggcggcacccaggctcccgatatcgtgggcgtggtctgtctggcccctcatgtgatgaacgaggagatctgcgtcgcctccatccgtcaggccaagctggcctatgagagcggcgacctgcgcgcccggctgatgaagctgcatcacgacaacgtggattgcgccttctggggctggaacggcgcctggctcgatcccgatttcatgcaatggaatctggaggaattcctacccggcatccgggttccggtgatggtgattcagggccgcgacgacgaatacggcagcgccgtgcaatacgaatccatcaaggccaaggccggagcgggcgccgaagtggtgctgctcgacgcctgccgccattccccccacaaggaccagcccgaggcggtcttggccgccatcacgcgctttgtccaatccataggatgatcccatgatccgcttgcagagctaccttgccgggcgttggcaggacggcgccggttcgggcgcgcaactgaaggacccggtgagcggcgaggtgctggccaccgcttccggcgacggcctggacatagccgaggccctggccttcgcccgggacaggggcggcccggcgctgcgcgccctgtcctttgccgggcgggcggggctgatcaacgcattggccggggtgctggccgagaatcgcgagcgctataacacggtggccctggccaattccggcaatacggcggtggatgcgggcctcgacgtggatggcggcatcggcacgctgaaatactacgcctccatcgggcgcaagctgggcgaggcgcggctgctggccgaggccacggacgaccagctgaccaaggacgaggcctttcgcggccgccacatttggaccagcaatcgcggcgtggccgtgcacatcaacgccttcaacttcccctcctggggcctgtgggagaaggcggcggtgagcctgctggccggcgtgcccttcctggccaagcccgccaccgccacctcgtggctggcctatgagatggtcaaggacgtggtggcggccggcgtgctgcccgaaggcgccatgtcgctgctgtgcggcggcgggcgtgacctgatggatcatttgaagcccggcgacgtggtggcctttaccggctcggccgagacggcggctcaactgcgttcgaatcccaatgtcatcgccgccaatgtccgcttcgcggtggaggcggattccttgaacctctgcgccctgggaccggacgcggcgcccgacgcgcccgagttcgccgccttcatcaaggaggtctcgcgcgagatgacggtcaaggccgggcagaagtgcaccgccattcgccgggtgctggtgccgcgcagccgggtggacgatgtggtcgcggcgctgaaacccgcgctggccaaggctttgatgggggacccccgcaccgagggcgtgcgcatgggaccgctggtcagccgggcgcagacggtggcggcctgggccggattggaggccttgaaggccgaaacccaggtggtggcgggtggcggtaacgacgatggtggttgtttcgtgccggcgacgttgctgctgtgcaatgacccgctcgccgccagggcggtgcacgagatcgaggtcttcggtcccgtggccaccctgatgccctacgacagcgtcgaacaggcggtggacctggcccacaagggcggcggttccctggcggcctcggtgttttccggggatgccgcctttctggccggcttcgttcccgccatcgccaccagccatggccgtgtcctggtggtggattccagcgtggccgccagccactccggccacggcgtggtcatgccccattgcatccacggcggtcctggacgggcgggcggcggcgaggagctgggcggcctgcgcggcctgcgtttctacatgcagcgctcggccatccagggcagccgaagcatgctggacgccatgacccagggcgcggcggtggtcgcgctttaagaaggccctcaccctcccggtctcggggccggtccctccctctcccgcacgcgggagagggttaaaaaggacgctcgcctccccacatgcacgatagtgcaagtgaatcggcaaagcggtactttaataccaaattgctcttgcgaatgattccagagctgcactatagtgcattcagtcattccaaccgaggcggcacgcccatgatcaactttcaaacctcccccgagagctaccgccactggaagctggcgttcgacggtccggtcgccacgctgaccatggatgtggacccggcgtccaccctggcgcccggctacgagctgaagatgaactcctacgatctgggcgtggatatcgagctttacgacgcggtgcagcgcctgcgcttcgagcacccggaggtgcgcgccgtggtgatggcctcggccaatcccaagattttctgcgccggggccaatatcaagatgctgggcgtctccagccacggccacaaggttaacttctgcaagttcaccaacgagacccgcaactccatcgaggatgccagcgagaattcgcgccagacctatctgtgcgcggtgaccggcacggcggcgggcggcggctatgaactggccctggccaccgactacatcatgatggtcgacgacggcaacacggcggtgtccctgcccgaggtgccgctgctggccgtgctgcccggcaccggcggtctgacccgcgtggtggacaagcgcaaggtgcgccgcgatctggccgacatcttctgctccatagaagagggcgtgaagggcaagcgcgccgtggaatggcgcctggtggacgaggttattccctcctcggccttcaaggcggcggtggccaagaaggccgccgagctggccgcccgctcggaccgccccaccgccgagaagggcgtggtgctgtcccaggtgtcccgcgtcatcggcaccgacagcgtcacctatccccacatcgacatcgccttcgaccgcgccacccgggcggccaatatcacgatcaaggggcccaaggccgcctgtcccgccgatctggccgggatcaaggcccagggcgttgatttctatcccctggccctggcccgcgaactggacgacgccatcctgcatctgcgggccaacgagaccaccatcgccacctgggtgttccgcacccaaggcgatgccgacctggtgatgggctatgacgcggcgctgcagacgttcggcgcctccgactggctggtgcgcgagatcctgctgtactggaagcgcaccatgaagcgtctggacgtcaccagccgcaccctgttcgccctggtggagccgggctcgtgcttcgccggcttcgtggccgagatcctgttcgccgtggaccggtccttcatgctggacggcaccttcgaggacaatccggcgccggccgccgccatccgcctgtcggcattgaacttcgacggcctgcccatgggcaacggcatctcgcgtctggccacccgcttcctgggcgagcccgacagcgtcggcaaggcccgcgacaccatcgggaaggatctggacgccgccgcctgcgccaagctgggtctggtcaccggcacccccgacgacatcgattgggaggacgagatccgtctgatgatcgaggagcgggcgtcgttctcgcccgactctctcaccggcatggaggccaatctgcgctttgccggtccggaaaccatggaaaccaagatcttcggccgcctcaccgcctggcagaactggatcttccagcgccccaacgccgtcggcgatcagggtgccctcaagctctacggcaccggcaagcgcgccgcctacaatcaggaaagggtgtaaccgtcatgtcctcgatcaattacgccgaaaagatccccaacaacgtcaacctgtccgaggaccggaagctgcagcgcgccctggaatcctggcagccccattatatcgactggtggaaggagatgggccccgaggggacctccacctccgagatctacctgcgcaccgccatcagcgccgagcccgacggctgggcccagttcggccacgtcaagatggaggattaccgctggggcatcttcctggcgccgccggaaaaggatcgcaaggtcaatttcggcgcccataagggcgaggacgcctggcaggaagtgcccggcgagtaccgctccatgctgcgccgcctgatcaccgtccagggcgataccgagccggcctcggtggagcagcagcgcctgctgggcaagtgctgcccctcgctctacgacctgcgcaacctgttccaggtcaacgtcgaggaaggccgccacctgtgggccatggtctatctgctgcacgcccatttcggcaaggacggccgcgaagaggccgaggagatgctggcccggcgctcgggcgacgcggacaagccgcgcatcctgggggccttcaacgagaagaccgccgactggctggccttcttcatgttcaccttcatcaccgaccgtgacggcaagtaccagctgtgcgccctggccgaatccggcttcgatccgctgtcgcggtcctgccgcttcatgctgaccgaggaagcccaccacatgttcgtgggcgaatccggcgtcggccgcatcatcgaacgcgcctgccaggtgatgaaggagaaccgcaccgaggacgtcaggaagttcggcgtcatcgacctgccgaccatccagcgctacctgaacttccattactcggtgacgtcggacctgtacggcgccgaggtgtccaccaacgcggcgacctcgtacaacatgggcctcaagggccgctacgaggagaccaagatcggtgacgaccaccagctcgagcacaccacctattcggtgctgcacccggtcaatggcggcttccaggcggtcgaggtcccggccctgaacgcgctcaacgagcgcctgcgcctggactgggccgaggacgtggccaagggcgtcgagcgctggaacaagatcatcgccaagcacggcatcgacttcaagctgaccctgccccatctggccttcaaccgcgccatcggccacttctccgacatcgcggtcgaccccagcggcaaggtcatctccaccgaggaattcgcccgtcgccgcgacgagtggctgccgtccgaatccgacctcgcctatgtgctgtcgctgatgggtggtgcggtgacccagcccggcaagttcgccaactggatcgcgcccccggcccgcggcatcaataaccagccggtggatttcgattacgtccggtttgcgtaaggacctctctccccccggctgagccggggggagagcttgattggagcgggccatggaactgaaacgccagcatctcatcgacccggtggtctgcatccgctgcaacacctgcgaggaagcctgtccggtcgacgccatcacccatgacggcaccaattacgtggtgtcctatgacaagtgcaccggctgccgcacctgcgtttcgccctgtcccaccggggccatcgacaactggctgctggtggaccagccctggagcatcgacgaccagttcggctgggaggaactgcccctgggccagaccggccccggcccggccgagcccgctccgctgccgcccggcgaggtcagcgacctgctggccgccgccacggcgaccaccgggccgtccgtgccgccgccggccagcgcggccaagccctatttcaacctctattcccgcgacacgccggtgacggcccgcgtcgccggcaatatgcgcatcaccggcgaggggacggactccgacatccaccacgtggtgctcgacttctcgcacaatgcctttcccttcctggaaggccagagcatcggcatcgtgccgccgggaacggatgccaagggccgcgcccacaacatccgcctctattccatcgcctcgccgcgcgagggcgagcggtcgggctgcaacaatctggcgctgacggtgaaacgggtggcgggaggcgtgggctcgaactatgtctgcgacctgaagaagggcgacgaggtgcgggtggccggtccgttcggccaggccttcctgatgcccgacgcccccaacgccaacatcatcatgatctgcaccggcaccggctcggcgccgttccgcgccttcaccgagcgccgccgccgcaatgcccaggatgcctcgggcaagctgatgctgttcttcggtgcccgcacgccggaggaactgccctatttcggcccgctgatgaagctgccgaaaagcctgatcgacgtgaacctggccttttcccgcgtgcccgaccggcccaagcaatacgttcaggacaagatccgcgaacgctccgacgatctggccgccctgctggcctcggccgacacccatgtcttcatctgcgggctgaagggcatggagcagggctgcgacgaggccttcgccgacatctgccgtctgcacggcctggattgggcggacttgcggccccggatgcgcgaagaagggcgctatcatgtcgaaacctactgagctcgaagagatcgaggccatggagggcggcgtgttcacccatcgccgccgggtccatttcggcgattccgacgcggcgcgcatcgtctacacgccccgcttcctggaatacgccatggaggcgctcgaggtcttcatggccgatgtcatcggctacgactggtacaccatcaataaggaacatggcttcggcacgcccttcgtgaagatcggcatggagatcaaggcgccgctcaggcccggcaaccgggtggacatctcggtgctggtggacaaggtcggcggctcctccattcactttcgcaccatcggcacgcgtggtgacggcgtggtggcgttcgagaccagtttcgtctgcgtcgtcgccgatcaggaaaaggtgaaggcggtgcccatgcccggccccatgcgggcacggcttgaggcctatcgtgcccggctggcggaggcggcggaatgagcgagaccatcctggtcgcccgcacgggcgacgtcaccaccatcaccttgaaccggcccgggcgcatcaacgccttcaatgtggagatgcacggcgcgctgcgctcggcggtcgcccatgccgccgaggacggcacccgctgtctggtgatcaccggggcgggcaagggcttttgcgccggtcaggacctgtccgaccgggtgtccaagccgggcgatccgccccccgatctgggggcgtcgctggatgcccgctataacccgctgatccgcagcctgaaggccctgcccatgccggtgatcgccgccgtcaacggcaccgccgccggagcgggcgccaatctggcgctggcctgcgacatcgtggtggcggccaggtccgccgccttcgtccagagcttctgcaaggtcggcctgatccccgattcgggcggaacctggactttgccgcgtctggtgggcacggcgcgggccaccgccctgatgatgctgggcgagaaggtcaccgccgagcaggccatgcagtggggcatgatctggcgctgcgtcgatgacgagcaattgctgcccaccgtgttggccatggcggcgcaactggcggcccagcccacccgggggctggcgctgatgaagaaggccctggcccgctcgggggccaataccctggatgcccagctggacctggagcgagacctccagaccgaggcgggatgcactcaggattatcaggagggcgtgcgggccttcatggaaaaacgcccgccgcgcttcgagggtcggtgaaaaattgggtgccaattcccatatgtccatgacctgaaaccgggagagcatcatggccgagcggtcgttccagcatgaaatcggcctgttgcgcctgggggagggggagaccttccggggcgagggcatcctggccgtcaccaaggcgctgctgcaatcgggggtcacctatgtgggcggctaccagggcgcgccggtgtcgcacctgatggacgtgctgatcgaggccgaggatctgctgggcgagctgggcgtgcacgtcgaggccgccaccaacgaggcgggggccgccgccctgctggccgcctccctggcctatccggtgcggggcgccgtcacctggaagtcggtggtgggcaccaacgtcgcctcggacgccttgtccaacctggcctcgcccggggtgatcggcggcgcgctgatcatcatcggcgaggattacggcgacggcgccagcgtcattcaggaacgcagccacgccttcgccatgaaatcgtccctgtggctgctggacccgcgtccccatctgccctccatcgtccatatggtggagaagggcttcgagctgtccgaggccagcaacacccccgtcatggtcgagctgcgcatcaaggcctgccacgtcaccggcagcttccaggccaaggacaacaagccgggcgcaccgattcaggcgccggccgccttcgattacgggcggctgtcgcacccgccgtccaccttcgcccacgaggcggccaaggtggaaaagcgcctgcccgccgcgcgggccttcatccgcgaacacaagctcaacgaggtctttcccggaacccgcgacgacgtcggcatcatcgtccagggtggcctctacaattccctgatgcgcgccctggccaagctgggtctggccgacgccctgggcaactcggccattcccatctattgcctcaacgtcacctggccgctggtgcccgaggaaatctcggccttctgcgccggcaagcaatcggtgctgatggtcgaggagggcacgccggaatacctggaacagaccctgtcgctgatgatgcgccaagccgacatccagacgaagttgcacggcaaggactgcctgccccaggcgggggaatacaccgccgacgtgctggccgccgggctggccaaattcctgggttccgagccggcgcaagccatcgtcaatgcggttgacgttcatcgcaagacggcggcggcgctgctggacaaggagcttcccggccgcccccccggtttctgcaccggctgtcccgaacgcccggtgttcgccgccctgaagctggcgcaaaaggacatcggccggactcatgtgtcggccgatatcggctgtcattccttcggcaccctgccgcccttttccatgggcaattccatcctgggcttcggcatgagcctcgcctcggccgccgccgtcgggccggtgacgggcaagcgcccggtggcggtgatgggtgatggcggcttctggcacaacggcatcatctcgggcgtggccggctcgctgttcaacaagggcgacggcgtgctggtgatcctgcagaacggctatacctcggccaccgggcagcaatacatgccctccaccctggccgaggggcaccgcaacgagactcccatggatatcggcgccacgctgaaggtcatgggagtgaagtggctgcgcaaggtgcggtcctactcggtttccaccatgcgcgacaccttcaaggaggccatcaggggggcgggccagggcctgcgggtgattatcgccgacggcgaatgccaactggcccgccagcgccgggtgaaggcagaggacgccgccaaattgaaggcgggggaaaaggtggtgcgggtgcgctatggcgtcgacgacgacatctgttccggcgaccacgcctgcatccggctgtcgggctgtccgtcgctgaccatcaagcccaatcccgatccgttgcgcgacgatcccgtcgcctcggtgattccgtcctgcgtcggctgcgggctgtgcggcgaggtggcccacgccgccgcgctgtgtccgtccttctggcgggccgaggtgatccagaatcccaccggtctcgatctctggctggacggaatgcgccgccgggtcatcggttggatgcaggggaggatcggcgcatgagcactccccatcccctgtgcatcgtcgtggccgccatgggcggcgagggcggcggcgtgctcaccgactggatcgtcgaggcggcccatgcctcgggcctggcggtgcaaagcacctcggtgccgggcgtggcccagcgcaccggcgccactacctattacgtggagatcttccccacgcccctggcggagttgggggacgcaaggcccattctggccctgtcgccgtcgctgggcgaggtggacctgatcgtcgccaccgagctgatggaggcggcgcgctgcgtgacgcgcggctggtcggacccggcgcgcactcagctcatcgcgtcgagccaccgggtccacgcggtggccgaaaagatggagatgggcgacggccgttatgacggggaccgcctgcgcgccgccattcaggcgggttcgcgccatcacctgttgttcgacatggagcaggcggccaagtcggcgggctgcatcgtcaacgccgtgctgctgggcgccgtggcgggcagcgggctgctgcccatcgcgcccgagaccttcgaggagcagatcgtcgcctcggccaaggcggtggagagcaatctgcgtggcttccgcctgggccttcaggcggcgcggggcgagattcccgcggcctcgacagcctctcacaagcgcccccatgccgaggtcccaggctcggaactggtggcggtgcaactgggcttcctgcccgccgccgcccgcgccctggcggaggagggggtgaaacgtctgaccgcctatcaggatgcccgctatgccgggctttacgtcgagcgcctgcgcgccctgtcccaggtcagcgccgacgaggccctgctggcccgggtggccaagcacttggcggtccgcatgtccttcgaggacgtgatccacgtggcccgcctcaagaccgatcccgcccgcctggagcgcatccgcgccgaagtgtccgcccggcccggtcagccggtggtggtccgcgatttcctcaagcccggtctggaggagatctgtgccctgctgcccggtgtcctggcccggcccatcctggccgccgcccatggcggtggctgggcgggcaaggcggcctgggggcgtcaggtcaatgccagcggcatcttcggcttcgccacccttcgcctgctggcggcgctcaagctctggcggcggcactcctaccgcttccatcaggagcaggcggccatcgaggactggctggcggctttgggcgatgccgcccgtctgtcgcccgccttagggattgaggtggccgaatgcgcccggctgatcaagggctatggcgagacctggaatcgtggctcggccaacttccgccgcatccgcgaggcggtgatcattccggccgccgccggccgctggtccctggatttcgccctggacgccatcgccaatgcccgggccgccgccttggccgacccggaaggcgccgggctggaccgcaccctggcggccatcgccgagcgggctgccgcataggcggattgacaggtccgaattgcccgccgatcctgtcggcatgaagcgtctcgcctgcatcctctgcctgctgcccgccctcgccctggccgagcccctgcgcctgcagggctatgtggagggcgagtacgtgcgcgtcgcgcccaccggggccggcaccctggccggcgtcgaggtgcgcgagggcgagcgcgtgacggcgggggcgccgctgttcgccctcgacaccctggtcgagcgggcggtgcgcgaccaggccgtggccgacctggagcgggccgaggcgcaactggccgacctccggaagggcaagcgccccgacgaactcaaagccatcgccgagcagaaggccgaggccctggcggcgctgcgcctgtccgaggcgaccctgaagcgccaggatatcctggcccgcaacgactatgcctcccgcgcccggctggacgaggcccgggcggcgctggagcgcgaccgcgcccaggtccgccggctggaggccgaataccgcaccgccctgctgggcgcccgccccgacgagatcgcggcgcaggaggccctggtggggcaaaagcgcctggaactggccaaggccgacaagcggctgctcgacctttcccccaaggccccggccgatgccgtggtggagaaggtctattaccgggtgggcgagttcgtgcccgccggtcagccggtggtgtcgctgctgccgcccggcaacgtcaagctggtgttcttcctgcccgaaccccggctgggggcggtgaagctgggcgatgccgtcggttacgcctgcgaccgctgcgcggcgggcgaggcgcgggtgtcgttcatcgccacccaggcggaatacaccccgccggtgatctattccgtggaaagccgcgacaagctggtgtttcgcgtcgaggcgcggggcgcggcggcggcgccgctggcccttaatcccggccagccggtggacgtttcggtgccggccaggtgaacggcgcggctgccatcgacgtccagggtctggaaaagcgctttgccggccgcgccgtggtccaggatttttccatcctggtgccccgagggcgcatcttcggctttctcggccccaacggctcgggcaagaccaccaccatccgcatgctgtgcgggctgctcacccccgatgccgggcgcggcacctgcctcggtctcgacatcttgcgccagtcggacgagatcaagcgccgggtcggctacatgacccagcgcttctcgttctacgaggacctgaccatcgccgagaacctggatttcgtcgcccgggtctacggcctggaccggcgcaagcagcgggtggacgaggcgctggccgatctggggctggccgagcgccgcaagcaactggcgggaaccctttccggtggctggaagcagcgtctggccctggccgcctgcgtgctgcacgagcccgagctgctgttgctggacgagcccaccgccggcgtcgatcccaaggcgcggcgcgatttctgggaccacatccaccggctggcggcgggcggcatgaccgtgctggtcagcacccattacatggacgaggccgagcgttgccacgagatcagctatctcgcctatggccgcctgatggtgcgcggcacggtctccgaggtgattcggggctcgggcctggtcacctggctggtggaaggcgacggcgccgaccggctggccttgcgcatggaggggcggcccggcatcgccatggcggcgcccttcggcaacgcgctgcacgtcagcggcaccaattcggcggcgctggaagccgccatcgcgccgtggcgctcggaccccgccctggtgtggagccgcaccgagcccagcctggaggacgtgttcatccacctgatggggcaggcggaggataatttccgatgaacggctccgcgtccctctcctggtcgcgcctgatggcggtgatgatcaaggaggtcatccagatgcgccgcgaccgcctgaccttcgccatgatggtgctggtgccgctgctgcaactggtgctgttcggctatgccatcaattccgatcccaaagggctgcccaccctggtgcaggtgcaggaggacggtcccttcgcccgcgccctggtggcgggcttgcgcaactcctcctacttccgcatggtgggcgaggtccgcaccgaggccgaagccgagcggcacctggccaccggcgacgcccagttcgtggtgaccgtcccactgggcttcgaggccgccctggtgcggggcgagcgcccggccctgctgctggaggccgacgccaccgatccggcggcggccagcaatgcggtggcggcggccggcgccctaatgcgcactgtgttcgacgccgaattgaccggcccgctgtcgtccttgcgcggccgacccgatcccgtcgatctgcgggtccatcggcgctacaacccggaaggaatcagccagtacaacatcgtccccggcctgatgggggtgatcctgaccatgaccatggtcatgatgaccgccctggcggtgacgcgcgagcgcgagcgcggcaccatggaaaacctgctggccatgccggtgcggcccctggaggtgatggtgggcaagatcctgccctatatcggggtgggctatgtccaggtggtggtgatcgtcgcctcgggccgctggctgttcggcgtgccgctgatgggcagcctgaccctgctgtcggtggcgctgctgctgttcatcgcctccaatctgacggtgggattcaccttttccaccgtggccaagaaccagcttcaggccatgcagatgagctttttcttcttcctgccgtccatcctgttgtcgggcttcatgttcccgttccggggcatgccggtctgggcgcagtgggtgggcgagatctttccgctgacccatttcctgcgggtggtgcgcggcatcctgctgaaaggcaacggcatggcggaaatctggcccgagatgtggccgatcatcgccttcgtgctggccagcgccctgctggccatgaagcagtaccgtcagacgctggactgacgggcctaacctttttgtcatcccgagcgaagtcgaaggatctcatcttggagcggcgttttcgaatcggcaccgctgctccgggcggagatccttcctccctttggtcgtcaggatgacaagcctgttctttcgacggccgccatgaaaccgttcaccgcaccttgctgacataggcgttgacctcgtcgttcagcgcctcgaccaccttggacagcgtccgggcgctccagatgacgcgcaccgtgccgccgcaggcctgggcggtggattgcgacagatgggcgacgttctccgagacttccgaggctttggtcgccacctcgtcgatatgggccgaaatgtcgcgggtcaccgcctcctgctcctgcaccgcgctggcgatggccgaggcgatgccgtcgatggtgcggatggtggaaaccacgccggcaacgccggtggcggcggcctgggcggcgccctgcaccgcccccacctggcgcgagatgtcgtcggtggcgcgtgccgtctgattggcgagattcttgacctcgttggcgaccacggcaaagcccttgcccgcctcgcccgcccgcgccgcctcgatggtggcgttcagggcaaggagattggtctgggcggcgatgtcgttgatcaactgcaccaccacgccgatctggctgaccgaatcggccagcccgttcatgcactccaccgtctcgccgatatcggagacggcggtctgggccaccgaggccgactgggtgacctgctgggcgatctcgttgatggcctgggccagctgccgggtggattcggacaccgccgaggccagttgagtggtggtttccgccgcctcgcccacggtgatggaacggccgccggcgctttccgaacggcttgccatggtttgggcggtgcggccgatgcccgtggtggcgctggccacctgggacaccatgtcgtggacgttcttctcgaaggcctgggtctgctggtcgcgggcttccatgtcgcccagcaccttgttgatcatctcggcataggtgcggtaatcgccgcgcaggccctggaggggaatgtagcggaagtattccttggcgcccgcccgcttcatggcggcgccggtgtccttggcgaattcctcggtgaggtcgagcacatggttgaggccgttcagcatgcggcccagttcgtcctggcggccgatgcgcagcacccggatgttcaggtcgccctgggcggcctggtgcgcggtggcggcgccgcgctcgatcaggctcagcaccgtcctcacctcgcgcagggcggccagtgagaccgcggtcaggaacagtccggccaggaccagcaccaccagcgcgccgccggcgaaaccggccccgccttccgtggcgaacaggcgccagatggcggcggcggccaccagtccgatcagggccacggcggtgccgacaaggaatgcggcggtattggtcctgccacgcagcgacggattggacatgctgtttctcctaccggctgatggtcatgaccagacggtcatagctgtcgaaacccagatcgccgatggtcttgaccagggcggcgaagctttgctccacgccttgcttgcggtcgggggcggcgttctcgatgcccagcagggtctcgtagagcggcttgaccgtggccaccgcctcggccttggggacgcggcggttggaatgatagcccaccatcttgccggcctggtcgtagcagggcgttacatgggcgaagacccagtaatggtcgccgttcttggcccgattgatcacataggcgaagacctcgtgcccctgggcgatgcggtcccacaggaacttgaagacgcagcgcggcatggccggatggcgcaggatcgagtgcggcgcgcccagaagctcttcctcggtatagccgctgatgcccaggaagacatcgttggcgtaggtaatctttccggtcaggtcggtcttggagacgatgacgtcgtcccactggaaggtcctctccacattggtaagcgaccgatcaatggccatggcgaagccttccgtcaggaataatgatgcaaatcagcgggttgagccgaaccgaggtcgcgactccccccgcggctcatccatccgtctcatgacgaaagtggagccccgcccgcaaggtgtcaaccggcatgaattctcagtgccatctcttgccctgtcccccgccatgtgtcccattgacgtcatggcggacataggctcccattcaacagtcaaacggggtggggatgaggtgaaaatgcgccgcattgtgctgttgtcgctgctcctctgcttgccggcggaggcgcgggaggtgaccgtgggcgtcggcctgtccctgtcgccctacgtgattcccgaggaattgcgcggcatggaatatgacatcgccaaatcggcgctggccctggagggtcacgagatgaagccggtgttcctgccgcttgggcgggtggccaaggccttggatggcggccagatggatgccgccatgacccagcggcccgggaccctgacgggtctagtctactcggacatctatatcgtctaccgcaactatgccatcaccctggcgtcccgccagctgaacgtcgaccgcctggaagacctgtcgggaaagtcggttctggcctttcaaagggccacgagctatctcggcccggagttcaagaaggtggcggaggccaaccaggcctaccgcgaagaggccaaccagctgatccagccgctgttgctttacaagggccgggtggatgtggtcgtggcggatcgcaatatcttcgactggttcgccaatcagcccgaggttcgcgacaaggccgacatcagccagccggtgacctatcacccgctgtttccgccgaccgaataccgggtcgccttccgggatgtcgccctgcgcgacgccttcaatcgcggcttggcccggctgagggccgagggcgaatacgaccggatcatcgcccgctattccaaagcccaggcgcccgcgctgtcgatcagcgggccttcgggcggatcgcgatgaaggtcatgtcgtcgcggcaaggctgatcgccgcgccacgcgtcgagggtggcgaacagcctttccttctgcagctccagcggcaggctgcccaggccggtcagggtttccagcagccgtcggcggccgaacagccggtggttggggccgcccatctggtcgatcagtccatcggtgtagaggtagaacgtcgcgcccggcgtgatggggacttcgtggcaggcgaaggtcgcgtcgggtgggctgtcgcggtagcccaggctgcggcggtcgccccggatcaccttcatctggtcgtcgctccacaccatcagcggaagattggctccggcaaaggtggcgacgccccgggcccggtcgaagacgcagatggcggcgtccaggccgtcatcggcgggggcgtcggcccggtcctgacgcagggccgacttcaccaggaaattgagcagggccaggatcaccgccggatcgtcatggccgtggtgatggaggatgcgggccagaatggacgagaccacggcggtcatgaaggcgccgggcacgccgtgaccggtgcagtccatcaccgcgacgacggtcttgtcgccgaagatgccggtccagtaatagtcgccgccgacgatgtcgaaggggcgccagcccacggtgaactcgtccaccgccccttccagcgccgccgtatcgggcagcagcgccgtctggatgcggctggcgtagcggatgccgtcggaaatgaagcggttggccttttccagctcggcattggcccgttccactccggccttttgctgctccagttcgtgggtgcgctcctgaacccgcaattccaggtcgcgggccagggcggccagggcgccttcggcggtgtcgcggccgtcgagtccgcgctgggattcggccaacaaggcgttgacgttgctgaccagcagccccagttcgtctccctcgtggcggtgcggcagctcgatgagcgaggccccgggccgggcggggtccaccttggcgatggcgtggcccaccttcagcagcggcttggtgatcaggccgtagaacacggccaccaccagcaggcacaaaatgaccgtacgggcggcgcccgaagcggcgctggcggtcacgtggtcgagatagcggccaagcagcagagcggggtcgaggcgcagttccagcttgccgacgtcgctggcggaatccttcatccgggtctgcagcatcagggaatgctgggcgacgtcgccgaacagcctttcggccagcctgggaaacgcggtgacgcccggtgggcggcgggtttcgcccagcaggtcgccgaaattgtcggtgagccgaacctcggccaccatggggtccagcgccagtccgctgaccacctcgccggccagatcgtggctcagcatataggcggcctccaccgccgtgccgcgcaccagggccagatcggccttggccacttcgaccacctcgcggcgcatgcgctggtaatcggccgacaggtcccagaatcccgaggccgctcccaggccgagggcgatgaccagcgtcgccaccgcctgcttgaaggagaggccgcggaatgtcccgatgtggcggatcggcaagggagatgaagacgctggaacggtcaccggggggggggctctcgggggataatcagtagagtccatgataaccgaggcaggcggtctgtcacgcgcattcgcgggcggcgggggcctggtcagggaccggagtcccatgcctttacttttgtcctatgcttgctgaacaagcatcaacctgccgtggacgtgtcactcaagtgaaccgccaggccgccccattccgagcgcccgaagtcgagagcgagaccgctcaaggtcgccagatcggcgacgatggccaggcccaggcccgaacccggcacgctttcgtccaggcggatgccgcgccgtgccgccgcctcggcctgctcgggcgacaggcccggcccgtcatcctccacccggaccgaccccgggccggcgcagacgcggactcgggtcttggcccatttgcaggcgttgtccatcagattgcccaccatctcggccagatcgtcggcctcggcggcgaaaagggcgtcggggggacactggatggcgatctccaggcggcgatcggcgtggaccttgcgcatggctccggccagatcggccagcaagggggccagcgccgtttgccgccccattccgcgggccgacgaggcttccgagccggcgcgggccagatgcaggtcgatcaggcgggtgaccctttcgatctgcggcgccacgccgggcagggtgccgcattcggcgcgcagcaccgccaggggagtcttcagggcatgggccagattgcccaggtggttgcgggcgtggcggatcaggttttcgtcgtggtccagcacccggttcatggcggcgaccaggggggcgatctcgcgggggtagccgccgccgaggcgggtgccgccacgggtcagctggcccagctccgcctccagccgcccgaggggcttgaggccatagcccacctgcaccgccaccgccaccagcaggcccaggccgaggccgcccagggacagggccagcaacagccggaaccggcggatctcctcctccacctcggcgcggtcggcggcgacggccacgtgcaggcgccgcccgttgtcgcccagcaccagatcgcgctccagcacctccagcttctggccgcgcggcccgtcctcgccgcgggtctggacggctcccggctggctgtccggggcgatggtcagggccgcatcccacagcgagcgcgagcgcatctgcagggccgcgccgtcggatacctgccaataccagccggaatagggctgttcgaagcgcggctcgcccgccgggcggcccacggtgacggttccgccctcggccaggtccacgaccgccagcagggtgcgcagatgggtgtccagtcggcggtgaaaggcctgctcggcgctgtcggcgaaggcgtggccaagaaccccgccgccgacccccagggcgagcagcacccaggcccccgcccccaggatcaggcggcggcggagggaatcacgggaggccatccatcgcctccatgcgccagccctggccgcgcagggtgtggatcacgtcgacgcccagcttgcggcggatgcgcgccaccagcacgtccagcacgttggaatcggggtcggcgtcgcggtcgtagacatgctccaccagttccgaacggctgaccacccgcccctgatggtgggcgaggtaggacagaatgcggaattcctgggcggtcagggcgatgggcaggccggcacggctgacccggccgcccacggtgtcgatgcgcaaggggccgcaggtgatctcgggcgaggcatggccggcggcgcggcggatcagggcgcggacgcgggtgaccacctcttccatctcgaagggcttggtgacgtagtcgtcggctccggcgttgaaggcctgggacttctccgcccagcgggcgcgggccgtcagcaccatcaccggcatggcccggcccgcctcgcgccagcggcccagcacgctgatgccgtcgatcttgggcaggccgaggtcgagaatgaccgcgtcatagctttcggtgtcgcccaggtgccagccatcctcgccgtcataggcggtgtcgaccgcgaagcccgccgcttccagggcacgttccagcgccagggtcagttgcggctcgtcttcgacgaccaggactctcatcgcttctccttgaccttgagacgggtgccgtcggcggcgtcgtaatagagcttgagcaggcgtccatcatgggtcaagcgcttgatctcgtagaccgggcggccgtgcttgtcctccagctcggcctcgatcagctcgccgggatagtcgcggtcgacctgttcgagaatccgcgacagcggcaggatcttgcccgccagcacggcccggcggatgcggtcgtgatcctcgcccgccgaaacggggagggagagcagcatgaacagggcggtcagaatgatcttcatgtccgaaatcttcgtccctgccccatgaacggcggatgaaccggcgggtcacgtccggttcaggggccgaagctcatcctctccccagatgagttcacccacaaggagttccctccatgctgacccgtatgattatccacggtctgctggccgccatgatcgtcgccgggggcgcctatgcctatgccgccaccgtgcagccggtgtccatttcctttcaccaggagcaccactgatgaacgcccgttgggagtttcgcctgcttcgcctgtggcacgccgccctggccggaggctttctggtggcctatgtcacggccgacgaggacacctatgccatgcatgtcttcgcgggctattgggtggtgggcgccatcgccctgcgactgctcctggcgctggcgggctcggccaccgggccgctggccctgcccaggccccgcctcacctgggccaagcccggccgcaatccgctgttcgcctggatggccgccatcctggcggtgggcatggcggtggccggcgtgaccggcatcgccgcagacctgattcctccgctggaggatctgcatgagggtctggccgaggcttcgctctggctggtactggcccatgccgccatcatcgcctggatcttccagggccggagggtgcgcgaaatgctgaagggcgccatgcccgccctgctggccatcgcccttctggccgcgcccgccgccttcgccgccgatgccgcccgcgaggccatcaaggccggctatgccaagcaggccggcgcgggcttcgccgggttctcggcggagcgcggccgggcgctgttcgagtccaggaacagtgccagccccgattacgcgtcgtgcaccacctgccacaccggcgaccccacccgctatggtcagcatgccaagaccgggcgggccatccagccggtggcggtctcggccaatcccaagcgcttcaccgatgcggccaaggtggaggagcggttcgaccgcgactgccagaccgtgctgggccgcgcctgcaccgccaccgagaagggcgactacatcgcctatatggagagcaaatgatgaagcgcatgatcctggcggcggccttgaccctggccgccctgccggcccgggccgatcaggtccgaccgctgaccgatcccgagacggtcaaggcctgcggcgaatgccatatggccttccagcccgccttcctgccggcccgctcctggaccagcatgatgggccagctttccgaccatttcggcgacaacgcctccatggcgcccgacaaggccgagcgcatccgccaggtgctggtggcgggcgccgccgacaccggcggcggcaaagcggggtccaaggccctgcgcggagtcagatcgaacgaggtgccgctgcgcatcaccgaactaccccgctttcagcgcaagcatgaccggattcccgaacgggagtggaagcggccggaggtgaagaccaagtccaattgcgtcgcttgtcaccggggggccgatcaagggtcctacgaggacgagtgagggatcgcccacccttcccccttccgggtgggcaaagtgcgggggccggcgttcgggagggatgagctccgggtgccggtccccgttactcgatccattcgcccttatagacgccccagatctcgtcgcgcttgaaccagccttgaatctggttgatctcgacgcggcagaagtcgcggttgcgcggacattgcagcaggcggcccagcaccccgggctccaccagggccagggcgtcggcgttttcggaatcgccggcgcgcagggtgcgctgaccgcccatcaccaccatcatgcgccgccccgacagcatggattggtgcagccagccctcggtgccctgccagtcgcggatcttgcgccaggcctcgaactcggcgatcacctccaccggcaggtccttgcgcgaatagatccagtcgatgggataacgctgtcccggccccgcccgcaggttgacctcgtccgagcgcagggagacgaaacgcggcagcggcaggccgctggcttcgcccgccgacgcggccggcgcaaggcccagcaacacggccgccagggcggtcgccccccatttacgcatctcggctatcccccaacgtcggcagttcatattccctccggcggcgtattataaggtcggctcgcccgacccggtcaaggcgagccggagtttgcgttttaaagaacctccaactgggctctggacaaggggtcgccgagttgctaggtcgatagggaaacgttccgggaggagtcaagaaatgcccagcaagaagcccgtcgtcgtggtcagccgcaagctgcccgacgtcatcgaaacccggatgatggaattgttcgacacccgcttgaacgtcgacgatcatcccatgaccaagacggaactgatcgaggcggtcaagatcgccgacgtcctggtccccactgtcaccgatcgcatcgatgcgggcatcctgtcccaggctggccccaacctgaagctggtggccaatttcggcaccggcgtcgatcacatcgacctggccaccgcccgccagcggggcatcaccgtcaccaacacgcccggcgtgttgaccgaggataccgccgacatggccatggcgctgatcatgtccgtgccgcgccgcatcgccgagggcgagcgcctgatccgttccggtgactggaagggctggagcccgaccttcatgctgggccaccgcatctggggcaagcgtctcggcatcatcggcatgggccgcatcggccaggcggtggcgcgccgcgccaaggccttcggcatgtccatccactatcacaaccgcaagcgcgtccatcccgacatcgaaaccgagctggaagccacctactgggagagcctggaccagatgctcgcccgcatggacgtggtcaccgtccattgcccgcataccccggccaccttccacctgctgtcggcacggcgcctggaactgctgcccaagcacgcctatgtggtcaacacggcgcgtggcgagatcgtcgacgagaacgccctgacccgcatgctgatccgtggcgatctggcgggcgccggcctcgacgtgttcgagcacgagccggcggtgaaccccaagctgctggcgttggacaacgtggtgctgctgccccatctgggctcggccaccatcgaaggccgcgtcgacatgggcgagaaggtgctggtcaacatcaagaccttcgccgacggccaccagccgccggaccgcgtcctggcgtccatgttctaagcattaccctgaacggcaaagccccccggagcatcgctccggggggctttttcgtgggctgggctcagttctgcatcatcatggggccatggccgtggccgtgacggccgccgtggccgaagccgccccggccgccggcgccgggcatcaggtcgtcggcgatcttctgctgctccagggagagcgaggcatagaaggcgctcatggccggaaccaccttgcgcagggcctcggcgcggatctcggcctgctgctgcatgcggcccatgcgctcgggcagggtggcgaacttggacggatcgaccttgtccgcgcacatcttggccatgggcgccgaggcttccttcatggtctcggccaagtgcttgaactcgaccttctgggcatcggtcagcttcagcttggtctcggaataggccatgtgggcggccatgcgggcgtccatgtcgccgcacatgcggctcatgcgctcgaagccggcggcacgcggcgcggcaggggcggggtcggcggcgcgggccacattcaccagggcggccagacccagggcgatggcgacggaggcggtgatcagggtaatgcggctcatggggacacctgtgaacgggtggattggaatgacaccgttctacaggggccgcgtaaccggcgaatgtcgccggcgggatgaaatggtaacggatggtaacgggagtgcttcagcaggatcagatgaacagcatgctgccggtcttggacgcgtcggccaggaaggtcaccacgccgcccttggccacggggacgtccggccgcaggccgtcggggtccatgcccagcgccttcagtcccatctcgcagaccatgaaggtgacgcccagcgccacgcaggcctccagcagatcctcgaagcggcccacgcccttggccttgaagctgtcatccacccatttggccgcccgtccgtccgagcatttcatccgcgtccaggcgggctggccatcgggaagcggcttttccagcgcacggcccgcccacatggtgaagaacagggtgaccggcgtgtttgaggcgatggcggcggcggccatcaccagggcgtagtggatgcggtcgaaatcgcccgagaacaccacgatggacagcttgtcgggagaatgacgttcagccgcagacattggcggtgctcccgtgggatgacaggtctgtgatggtgggatggtcgccgcagagcggacagcccgggtcccgtggcacccgcacggtgcggaaggccaccgacagggcgtcgtagatcaccagcttgcccgccagggattcgccgatgcccagcaattccttgatcacttcggtggcctgcatggcgcccatggtgccggcgatggcacccagcaccccggcgctggaacaggtgggaacatggccctcgggcggggcctcgcggtagatgcagcgatagcaggggccgccgggccggtaggtggacaactggccgtcaaagcgcaggatggcggccgagaccagggtcttgccctcgaggcgcgccgcatcgttgaccaggaagcgggtggggaagttgtccgagccatcggcgatgacctggaaatcgcggaagatgtcccgcgcattgtccttgcccagccgcgcccggatgggcaccaccttgacgtcgggattgatgtcggccacggccgccgcggcgctggccaccttggccgctcccacgttggaggtgcggtggatgatctggcgctgcaggttggacagctccacgtcgtcgtcgtcgatcaccccgatggtgcccacgccggcggcggcgaggtagagaatcaccggcgagcccagcccgccggcgccgatcaccagggccgaggaccccagaagcttcgcctgtccgatgccgcccacctccggcaggatgatgtggcgggcatagcggtgaatctgctcctcggtgaagtccatgcggcggcccttgaacgaaatcacccccggagacgatccgggggtgacgactatacaggatggagccgaaaggcctctagacctgatcgaacagggcggtggacagatagcgctcggcgaagctggggatgatggcgacgatcagcttgccggcattctcgggacgcgagcccagttccagggcggcggcgatggccgcgcccgacgagatgcccacgggaacgccttccagcttggccgccttgcgggcggtggccagggccgtctcgttgccgatctgcaggatctcgtcgatgacgcccttgtccaggatatcgggcacgaagccggcgccgatgccctggatcttgtgcgggccgggggcgccgcccgacagcaccgggctgtcctccggctcgacggccaccatcttgaggccgggcttgcgagccttcagcacatggccgatgccggaaatggtgccgccggtgccgacgcccgagacgatgatatccaccttgccattggtgtcgttccagatctcctcggcggtggtgcgctcgtggatggccgggttggcttcgttcttgaactgctgcggcatgatggcgccgggggtggaagccagcagttcctcggcctggcgcacggcgccggtcatgcccttggaggccggagtcagcacgatctcggcgccgaggagctgcagcatcttgcggcgttccagcgacatgctttccggcatgcacaggatcagcttgtagcccttggcggcggcgacgaaggccagggcgatgccggtattgcccgaggtcggctcgatgatggtgccgcccggcttcagctggcccgagacctcggccgcctcgatcatggcgaagccgatacggtccttgaccgacgccaggggattgaagaactccagcttgccgacgatgtcggccttggacccggcctcggcggccatgcgcttgaagcgcaccagcggcgtggcgccgatggtgtcgatgatgctgtcataaatcttgccgcggaaggcgggggcggaagtggtcatctcgaattccccacgaaaagtgtgtagtacgatgcataactacatcgtatcaaggttagatgatgaagtccaacttctgatgcgcctcgctggggatgccgtccttgtaggcgcgcatgcacagctcgtcgatggagatggcgtccaggcgggacatgatctcttcggtcagatcgccccacatgggccggatgacctgagcacccaactgcgaggcgggcatgtcctggtaggggtcctcggcggtttccagggcgcggaccacgcgcaccacctcgcccacggaaatgcggcggcgttcccgcgccaggcgatagccgccccgggggccgcgcacgcccaccaggatgccggcgcggaccagctgctgcagggtctgttccagatagcgccgcggaatcccttggcgccttgtgatctcgcggctttgcaccggctcgccgccggcgtgataggcgatgtccagcaccgcctcgatggcgaacagcatcttcttggaaggccgaagcatgtggtctagcccttctttcccgttcccgtggagccgaagcccccggttcccctctgggtctcgtccaaactttccgcctcgcgccacgcggcgcgggacaccggcgcgatcaccatctgggcgatgcgcatgccgcgagagacggcgaaggcggtctggcccagattgaccaggatcaccccgatctcgccccggtaatcggcgtcgatggtgccgggcgcgttcagcacggtgatgccgtgcttggcggccagtcccgagcgcggccgcacctgggcctcatacccttcgggcagggcgatggcgaagccggtgggcaccagggcgcgctctcccggcgccagggtgatgtcggcgggaagacaggccatcaggtccatgccggccgcatgcgccgtctcataggcgggcaggggcagatcggcggcgtgttccagacgtttgatgaggacctcaaccattacgctttccccaaagcctttgtgatgcgttcggcaagattgcgggccacgtcgtccttgctcatggcgggccaggattccgtgccggtgccgtcgatgatgtgaacggtattggcatcgccgccgaaggtgccgctgccttccgagacgtcgttggcgacgatccagtcgcagcccttgcgtgccagcttgtcggcggcgtgttccatcagcttttccgtctcggcggcaaagcccaccaccagccggggccgcaagggcgcctcggccttggagacggtcatcaggatgtcgggattgggcgccagctggatggtgggcggcgggtcgcccgccttcttcttgcgcttctcgctggcgcggttggccacggtccagtcggccacggccgccgcgcagaccaccagatcggcgggcaggcgctggcgcaccgcgttgagcatctgcagggcgctttccaccctgaccacggtcatgccggcgggatcggccagggagaccggcccgctgaccagggtgacctcggcccccattgcggccagggcgctcgcgatggcgtggccttgcttgcccgacgagcgattggcgatgaagcgcaccggatcgatggcctcgtgcgtcgggccgctggtgacgatggccttgacgcccttcagggggccatcggacagcatggcctcgatgcgggccaggatctcggcgggctcggccatgcggccagcccccacttcgccgcaggccaggtcgccggccccggggccgatgcgggccacgccgcgggcttccagggtggccatgttggcccgggtggcggcatgctcccacatcatggtgttcatggcgggcgccaccagcacgggcttgtcggtggccagcagggcggtcgacgccagatcgtcggcgatgccggcggccatcttggccagaagattggcggtggcgggcgccaccaccaccaggtcggcctcccgcgacagccggatatggcccatctcggcctcgtcgttcagcgagaaggtctcctgatagaccttgtcccccgacagcgccgcgaccgacagcggcgtcacgaaattggccccgcccttggtcaggatgcagcgcacggcgcatccccggtccttcagacggcgaatcagttccagcgacttgtaggcggcgatgccgcccgagatgatgagaaggacccgcctgccatccagcactgtgaagcctcggaaaaatacgtgggcgaagtgtggttacggtagcgggtggatgacggcgatgcaaggggggagtcggccccaacgaaaaacccccctcccgttgccgggagaggggcttcgcgtaagcgcggtaagcgctgggtcggttggcttggacttagaagtccatgccgcccatgccacccatgccgcccatgccgcccatgtcgccaccgggcatgccaccggcgtccttcttgggacgctcggcgatcatggcttcggtggtgatcagcagaccggccaccgaggcggcgtcctgcagggcggtgcgcacgaccttggtcgggtcgatgatgccggccttgatcatgtcggtgtagattccggtctgggcgtcgaagccgaaggacaggtccttggactcgccgatcttgccggcaaccacggcgccgtcgtggccggcgttctcggcgatctgacgcacgggggcctgcagggcgcgacgcacgatgctgatgccgacttcctgatcggcattgccggaggccaggccttccagggccttgacggcgtgcagcagggcgacgccgccgcccgggacgatgccttcctcgaccgcggcgcgggtggcgtgcagggcgtcgtcgacgcgatccttgcgctccttcacctcgatctcggagccgccgccgaccttgatgacggccacgccgccagccagcttggccagacgctcctgcagcttctcacggtcgtagtccgaggtggtttcctcgacctgcgcacggatctgcttgcagcgggcgtcgatggcgcccttgtcgcccgagccgtcgacgatggtggtgtcttccttggtgatggtgatgcgcttggacgtgcccagcatctccaggttgacgctttccagcttgatgcccaggtcttcgctgatgacctggccaccggtcaggatggcgatgtcttccagcatggccttgcggcgatcgccgaagcccggagccttcacggccgcgaccttcaggccgccgcgcagcttgttgaccaccagggtggccagggcctcgccctcgatgtcctcggcgatgatcaccagcggacggcccgactggaccacctgctcgagcaccggcagcaggggctgcaggccggacagcttcttctcgtgcagcaggatgtaggggttatccagctcgacggtcatcttctcggcgttggtcacgaagtacgggctggtgtagccacggtcgaactgcatgccctcgaccacgtccagctcggtgtccaggcccttggcttcctcgacggtgatgacaccctcgttgccgaccttttccatggccttggcgatcatgtcgccaatttccttctcgccattggcggagatggtgccgacctgggcgatctcggcattggtggcgaccttgcgcgaccgcgacttgacgtcggcgaccacggcggccacggccagatcgacgccgcgcttcagatccatggggttgaggccggcggccacggccttgacgccctcgcggacgatggcctgggccagcacggtggcggtggtggtgccgtcaccggccagatcggcggtcttcgaggccacttcgcgcaccatctgggcgcccatgttctcgaacttgtcggccagctcgatctccttggcgacggtgacgccgtccttggtgatgcggggggcgccgaacgacttctcgatcaccacgttgcggcccttggggcccagggtgaccttcaccgcgtcggcgaggatgtcgacgccgcgcagcatgcgggtgcgggcgtcggtggagaacttgacttccttggcagccatttgtcttaacctctatagaattcttgggttaggcgagaatgccgagaatgtcggattccttcatgatcagcagatcgacgccgtcgatcttgacctcggtgccggaccacttgccgaacagcacgcggtcgccggccttgacgtcgagcgccaccagcttgccgtcgtcgccacgggtgccggaaccaacggccaccacttcgccctgcatgggcttttccttggcggtgtcggggatgatgatgccgccggcggtcttctcttcggcgtcgaggcgcttgaccagcacgcggtcatggagcggacggaacttcatttcgggaattacctccgtgagacgtttcgatccgccggggtgctgttagcactctccggcgacgagtgccaaccatctaggaggggtctgggggagagtcaagcaagtttaggtgaatttcccggcaccgttgcgccaacttaatgatttgtaatgataaatttccgccatggacttgccgtgattcgcacctacattgtgtgttccggtttcttgaacgggatgaagacccatgaccccctccgaacgtgacctgatccaaagcgtgttcgaccgtctggcgaggctgacgggcggacccaaggaccgcgaggccgaggccctgatcctcgaccgcatgcgcgcggtgcccgattccgcctacaatctggtcgaggcggtggtggtgcaggaaatggccatcaaggagcacgaagcccgcatccgtgacctcgaggcccaactggccgggcggtcgcagcaaccgacggggggcggcttcggccagccgggcaatccctggggcggtgggcgcggttcggtgcccgccacccagccctcgcaacagcaggtgcagcaacagcaatacgctcccccgccgcagcagcaatacgcccagccgtcgccctggggcggccagccgtcggccggcggcagcttcctgcgcacggcggccggcgcggcggtgggcgtggcgggcggcatgctgctggccaacggcatttccagcatgttcgccggcggccatgccggcggttcgccctggggcggcggggcgcagcaggccggcgacaccaccatcaacaattactatggctcgcaggccccggcggccggtggcgaggcgccccagccgacctatgacaccaccatcgccgacgaccagggctatgccgatttcgaccccggctacgacgtgggcggcggcgacgacagcttctagaccaccgagcgtcaaatatgacgctcggtggtctaggattcatatttgtccctctgccttagcgcggccctccggccgcttggccgcggcctcaatggccgctagaacaattgcaatggcggaaaccgctcccgtataaagggggcggtttccttgtttcgagagcccgacatgatcctctacaccctgcgctgctcccatgatcaccacttcgaggagtggttcgacaacagcggcgactacgacaccaagaaggatgccggcgcgctgacctgtcccgaatgcggtgacaaggaggtgggcaaggccatcatggctcccaacgtgggcaagggccgcgccgccgccgcaccgccgccgtcctgcggcacgcccatgggctgtggcggctgccccatggcgggccagcactgaggacatgatcgggctgccgcccgtgcccgcttggggcgatgccccaaaccccctttgttttcaaaattaaaggagggttcgggaggttttcctcccgatggggtcggggcaaagccccgctgtcctacttttggtccaccgtttccagcaaggccagcagcccggccaggatctggcggggcgagggtgggcagccggggatgtgcagatccaccggcaccacgtcggagactcctcccaccaccgcataggacccggcgaaacagccgccgtccttgccgcaatcgcccatggcgacgatccagcgcggctccggcgtggcttccaccgtgcgccgcagggcctcctccatgttgcgcgtcaccggcccggtgaccagcagcacgtcggcgtgacgggggctggcgacgaagcggatgccaaagcgctccagatcgtagatggggtggttgacggcgtgaatctccaactcgcagccattgcacgagcccgcatccacctcgcggatggacagcgagcggcccagccttgcccgggcgcggcgccccagcgcttcggccagttcctccaccccgttggggtcgggacgcggcgcgtccttcatggtgtgggggcccttgagcagatggcgggccaggatcttggcgatgggcgggatcatagatcatgccccgaatacgagcagttgaacgacttgttgcacagggggaagtcggcgacgatgttgccctcgatggcggcttccagcagcggccactggaaccacgaggggtcgtgggggtggcagcgctccaccacatggtcggcgcccaggcgaagccagaccaccacctcgccgcggaagctttccgccacgcccatgccctcgcccgccacctcgggcagcgggacgcggacggcgccttcgggcatctcgtgcagcatgcggttgatgaggtgcagggattccttggcctcggcgaagcgcaccagcacgcgggcgttgacgtcgccctcggtcagcaccggcacggtcatgtccagcttgtcgtagggcggatagctgggcgtctcgcgggcatcatggccccgccccgaggcccgccccacgaatcctccggccccgaaccggtggatcagcgaggtttggacgatgccggtggacacggtgcgatccgacagggagggcgtgttctcgtagagctggtagccctgctccagcagcttgccaaagccgtagagcaggtgcttcagcgcttccaccccctcgtcggagaggtcgagggagacgccgcccggcacgatgcggtccatgttgagccggtggccgaacaggacgtcgttggcgcgcagaaccttctcgcgcagcacgcccatatgggagagcatcaccgcgaaggccgcgtcgttgcacaccgcgccgatgtcgaagacgtggttggccacccgctccatttcggccatcacgccgcgcagccagtgggcgcgggcgggcacctcgcagccggtggcggcctcgaccgcccgggcgaaggccagggaataggccacggtggaatcccccgagacccgggccacaatgcgcgccgccttgtccaggggagcgccttgcagcaatccctcgatgcccttgtgctgatagcccaggcgctgttccagacgcaccaccgcctcgccctggcagtgaaagcggaaatgccccggctcgatcaccccggcatggaccggacccacggggatctggtgcagtccgtcgcccaccgcctgcaggaaggggtagcggtcgggttcggccgacggcgccatgggctgggcggccagcggcatgcgcgacggccagcggccatggtccagccaatggcgccggtcctccagccccaccggcgtcaggccccagacgtcgtggatggcccgctcgatgcggatgactccgggccgcacattgcccagcgccaggaaccggcggtcgtcgcatcggtgggaggccacggcgatgtcgccgctggcctcgtccctgagcgccacatggatctccgagcgctcggcccattcggccatcaccgaccattccgccacccgcagatggtcgatcagctggcgccagcccctgaggtcgagggcaaagcgcggccacggccgatggccctcgacccgccggccgagggagagaaactccagcagggtgatgtcgcccatcatcccaggatcctcgccacgttctggaaccacgccaccagttcccggggcagatacaggccggccaccagcaccagcagcatgtgcacccataacggcgtcagtgccagggcggtggatagcggaccggcatggccgtgggcatgggcatggggcggcggctcgccgaaggccatgctttgcagccgggccaccagggcgccgaaggccagcagcaggccgacggccagcggaatggccagcagcggctggcgggcgaaggtggagcccagcaccaggaactcgctcatgaacacccccatggggggcaggccggcgatggccagcaccgccagcacgaagccccagcccagcaccggatgcgaactggtcagcccccttatggcggcgatgcgcttggtgcccagattctggctgatgatgccgaccgcgaagaagatggccgacttggtcagcgagtgcatggtcatgtgcagcaggccggcgaaattggccacggcgccgcccatgccgaaggcgaaggtgatgacccccatgtgctcgatggaggaataggcgaacagccgcttgatgtcgccccgccggtacagcatgaaggccgacaggaacagggacgacagccccatcaccaccagcagcggccccggcgtcagggtgttgccgttggcggcgatgaccatcttgaagcgcagcagggcgtaaagcgccacgttgagcagcaggcccgacagcaccgccgagatgggtgtcggcccctcggcatgggcatcgggcagccaggcatgcagcggcgccagacccaccttggtgccgtagcccaccagcacgaagacgaaggccaggttcagcaggtcgggctggaaatcatgggctcgcttgatcatcagggtccaggccatggcgtcggcgccgtcgcccattaccggctgggccgccagatagaccagggtggtgccgaacagggcgaggccgatgcccacagagcacaggatgaaatacttccacgccgcctcgatggcctcgcgggtgcggtacaggctgaccatcagcacggtggtcagggtcgccgcctccaccgccacccacatcacgccggtattgttggcgcacagggccagaagcatggtgaacgagaaggcctggtacatggagtggtaaaagcgcagatgcaggtccgacaggcgctgggcctcgctttcgcgtgcgatgtaggcggccgagaataccgaggtggtcaggccgacgaaggcggtcagcaccaccagatagacgttgaaatcgtcgatgaacagcaggcgggtcggctcgggccgcacgtggatcagcaccagggacgaggcgaaggtgacgcccgacgccgccacgttgacccaggccgccacccgccagttcctcagcaccgccaggaacccggccgagcccagcggcacgcccaaaatccacagcagcggattgtcgaagccgggcagcagggcgaaggcgccgaccatcagcgatccccccgatgggtttccagatcggccagatccagggtgtcgaagcgctcgcggatgcggaagaagaagatgccgaacagggtcatggccaccagcaccgagaacgccaccgagatctccaccaccagcggcatgcccttggccgagaccgcggccaggatcaggccgttctccagcgccatgaagcccaccacctgggtgacggcgttgcgcctggtgatcatcatcaacaggcccagcagcaccacgctcatggccagcgccaggctttcccgcgtcagggccgccgcgttggcggtgaccggcagcaccagcaggatggacagggtgaccagggccacgccggccatcatggtccagccgatggacatggcggtttccacgttcttgtggatgcccaactgctcgaccagccaatgcagggcgatggggacgatgatcgccttgaacaccagggcgatgccggcggtgacatagaggtgcggcgcgtgctggacatgggcctgccacgccgccgccgccgccagggccagggcctggaaggcgaaggtgttgagcaccgcgaacaggcggcgctggtacagaagctggaaccccgccatcagcacggtggcgccgatcagatgggcgatgtcgtaggagatctgggcgcccatcacaccgcctccgagacgtagaggaagatggtggccagcagacccagcagcagggcgccgccgaggaaatcggcgtagcggaagacgcgcatcttggcgatggaggtctcgaacacgcccagcgccgtggccaggacgaagcacttggccaggaaagcggccagaccgaccagcacggcgaccgcgtcgcctcccggctgggccatgccccagggggcgaacaggccgccgatcagcgccatgaacagggtcaggcgcaccatgcccgcgccctccatcagggccagatggcggccggaatattccagcaccatggcttcgtgcaccatggtcagttccaggtgggtggcggggttgtcgatgggaatgcggccgttctcggcgatggcgaccatcaccagggcggccagggcgaggcccagcgacacctcgatgccgactccgcccgacagcacgaaggcgatgatctgggccggcgccgtggtgccggaaatcaacgacagcgagaaggtcaccatcagcatggccggctcggccaggctggagatcatcatctcgcgggacgctcccaacccgccgaagctggtgcccacatccatgccggccagggccgtccagaagcgcgccacgcccaagagcgccaccagggcgatcaggtccgcggcctgggccaggaacaggttggtggtgaaggcgggaacgatgcaggcggccagccacgccgcgccgaaagtgacgtagggcgccacgcggaacacccaggaggcggaatgggcgaccaccgcctccttctgcagcaggcggtagatgtcgcggtaaggctggaagggcgaggcgccgatgcggccgttgaggcgcgacttgaccagccgcacccagccagtgatcaacgggctgatggccacaaccaagacgatctgcagcaattgccagaggatggcgctcatggggtcgtcctccccgtcccgtcatcccgagcgccggcgagggatctccgcttggcctggcggtgccggtcctgagacgtcgcaccaggacgggatccctcctcccgttggtcgtcgggatgacggatcggatcgccgtgctttatcccgctcattggctctgcctcaccgcgaccaccagcagcatgatcaccagggtggagaacatcatcagcaggtaatgccgcaccgtcaggtgctggaagcggttgacccggtcggcgatgaagtccaccactcggccgattccggcgtaaagcccaacccagatgggatcgacgacccgcaccttcagctccgccggtcggttgtcgccgggatcgggcatgtccacgctttcccgcgccgcgaagatggaggcgcagaacacccggcgcagcggctgggagaagctttggccggtgtactggctttgggggatgctttccttgtgaccgcaatcccaggcatcggcgcggcgaattctggtggtgccgaagccgtgcaccagcagcagggtaatggcgcacagccccgctccggtcatcaccagcacggtgcccgaatacgagccgcgggtggaactgaccggcgagagccacggccagcccagatcggcggagacggcgaactgcactccggtcagcggcgtcaccacatgggagagcgcatcggtgacggtcaccggaatggcgcccagcaccacgcacagcgcggccagcaacgccacggtccagcgcatggaggcgggaacctgatgggcctgggcggcggcctccgagcgggggcgtcccagaaaggcgatgccgtaggcccgcacgaagcaggcggcggccagggcggcggccagggccagcatggcgcccaccaccggcacgccgaacttcatggcccagtggggcaggctcgggcccttgaacagggactggaagatcagccattccgagacgaagccgttgagcggcggcagggccgagatggcgatggcgcccaccagggcggcgacgccgttccacggcatgcgcttggtcaggccgcccaacttgcccaggtcgcgctcgccagtggcggtgatcaccgcgccggccgacaggaaccacagggtcttgaagatggaatggttgacgatgtgatacagcccggccaccagggccagggcggccagagtcttctcgccgctgcccttgaaggcgatggccagccccaggccgatcaccaccacgccgatattctccaccgtggaataggccagcagcttcttcaggtcgtcctgcaggatggcgtaaagcacgcccatcacggcggtgatgccgccgatggccatcatcaccgcgccccaggcccagctcacctcgccgtggaggtcgaacaggatgcggatcaggccgtacagcgctaccttggtcatcaccccgctcatcagggcggagacatggctgggggcggcgggatgggccaggggcagccaggcatgcagcggcaccagacccgccttggacccggcgcccagcaaggccagcagcaccaccaggaagccggccaccccgtccagcttggcggcgcgcatggcggggaaggaataggccccctggccgccggccatcaggccgaaacaggtcagcaggcagaaggtgccgaagcaggccatcaccagatagacgaaggcggcctggcggttctcggcgttcttgtgatcggccagcaccagcagccacgaggacagcgacatgaattcccaggccaccaggaacataaaggcgtcgtcggcgatcagcacggcgttcatgccgaacaggaacaggggatagaacggggtcacccgccggggctcgggcagatgcgagcaatagccgatgccgtaggccgaggcggcggcggtggccagattgaccaccaccatgaacagggccgacagattgtcgaggcggaaatgggcggccatccaggggaggccgatgggcagcacgatggccgggccggtgccgggcgtctggcccagatgcttgatccccccggccagcagcgccagggatgcaatcatgcagcagaaatagaccaatcggtgccgccacatttccgcacccgccgccacgccgagcacggcgagggccagaagagcggaaagggcggcggcgatcagcatcggctgcgcgacctcatggatttctgcggcccctcgccgggcgcgcgcctccgcgcgcttggccgccgcctcaatggcggctgggcatgacgcagggaagctgcatcatgctcgactgctccgtcgcagaacatggcgatcgtctcccgtgaatcccctgtcggcggggccggttgttccggccctcttcaactcgtcttatggcgaggagacgggaatcatacccacccaggggggcgggcgcaaggccgccccaggtctaatttcgcgccagggcccgccaggcgatgtcgcgtcggcagaagccgcccggccagtcgagcgcgtccactgccttgtaggcccgctcgcgcgcttcggccacggtcctgcccttggcggtgacgcccaggacgcggccgccggtggcgaccacctgtccgtccttcatggccgtgccggcgtgcagcacggtgacgccgtccacctgggcggccttgtccaacccgccgatgacggtgttcttctcgtaggcgccgggatagcccttggcggccatcaccaccaccagggcgacgtcgtcggaccatttcagctcgatgcccgacagcttgccgtccgcccccgccgccagcaccggcagcaagtcggagtcgaggcgcgccatcagcacctgacactcggggtcgccgaagcggacattgtattccagcagcttcggcccggacttggtgaccatgatgccggcgaacagcacgccggtatagggcttgcccatctcggccatggtcttgaccaggggcaggatggaccgctccatgatctcggcctggatggcgtcggtgacgacgggagcgggggaataggcgcccatgccgccggtattggggccggtgtcgccgtcgcccacccgcttgtggtcctgggcggccaccaggggcagcgccgtcttgccgtcgcacagggcgaagaacgagcattcctcgccgtccaggaactcctcgatcaccagctcgttgccggcgtcgccgaacacacgctcgcccatcatcatgtcgacggcgcccagagcctcgtccagggtcatggctaccaccacgcccttgccggcggccagcccatcggtcttgaccacgatgggggcgcccttggcgcggatgaagtccttggccttctccatgtcggtgaagcggccgtaccaggcggtgggaatgccggccttggccgccacatccttcatgaagcccttcgagccctccagctcggccgccgcggccgaggggccgaacaccttgatgccggcttcgcggcacttgtcggccagaccgagcaccagcggcgcctcgggtcccaccaccaccagatcgacggcgttggcctgggcgaaggccagcaactcgtccaccttctcggctccgatggcgacgcattcggccgagtcggcgatgccggcgttgcccggcgcgcaccacagcttggtcagcaagggcgaggacttgagtttccagcacagggcgtgctcgcgcccgcccgaaccgaccaccagaaccttcatgtccgcctcccggagtgatgactggggtcgtttatcacttccgtccgcgtttgcaaatcaccggctcttgcgccaccatccgcccatgagtgacgaagcccgccccgccccttccaacgtcccggaatactcggtctcggaactgtccggttccctgcgcaaaaccgtggaggacgccttttccttcgtccgcgtgcggggcgagatctcgggcttcaagcgccattcctcgggtcacctctatttcgccctgaaggatgccgacgcggtgctggacgccgtgtgctggcggggcagtgccgggaagctggccatcggccccgaggacggcatggaagtggtggcgacgggccgtctgaccacctatcccgggcgctcgaaataccagatggtggtcgagcgcatggaactggcgggccagggcgccctgctgaagatgctggaggaccgcaagaagcgcctgatggccgaggggctgttcgacacggcgaagaagcggccgatccccttcctgcccgaggtaattggcgtggtgacctcgcccaccggcgcggtgatccgcgacatcctccaccgtctggccgagcgctttcctcgccgggtgctgctgtggccggtggcggtgcagggcgatggcgcgagcgcccaggtggccgccgccatccggggcttcaacgccctgaagccgggcggagccgtgccgcgccccgacgtgctgatcgtcgccaggggcggcggctcgctggaagacctgatggccttcaacgaggaaatcgtggtgcgggcggcagcagaatcggagattccgctgatctcggcggtggggcacgagaccgataccacgctgatcgacttcgcctccgacctgcgcgcccccacccccacggcggcggccgagaaggcggtgccggtccgtgccgaactgatcgccaccgtcgccgacatgggggctcgcctgatcggcgccatgcagcgcgggctggaggagcggcgcactcgcctggggcacaccttccgggcgctgccccatccccgccgggtgatggaggattgcgccaggcgtctggacgagcgggccgagcgcctgaccaatgcgccgcgcctgctgctggagcgccgccgggccgagctggaccgtctggccgcccgcctgcgccacccccgtgagcaactggccgaggccgggcacaagctgacggcgctgaccacccgcctcgatcacgccatgaagacggtgagtgcggccgagcgtgccgccaatgagcgccggacgcttcaactggagcaatgtgcggggcgtctgatccaggccatgccccgcctgctcgatgagaaggccaagcgggtcgcccatgccgggcagcttctggaaagcttctcctaccgtaaggtcttagagcgtggtttcgccgtggtccgggacgagcacggcactccggtgacctctgtcgccgccgccaagccgggcgccgctttggcggtggagttcgccgacggcaaggcgggagtcagggtcgagggaaccgccgctccgcccgcccccaagccccatcgcaagccagccacgcccgatgggcggcaggggtcgttgctgtaattgtggaatatgggctgccgcccatacccgctcggggccgggggccccaaaccccattcatgaaatcaaaggggggccggggcatcgccccggatgggttcgggcgatagcccgataactattccattcccaccagggacttggcaaaggcatccgcctcgaagggccgcaaatcctcggccttttcgccgattccgatggcgtggaccggcaggccgaatttctcggccagggccaccagcacgccgccccgcgccgtgccgtccagcttggtcagcaccaggccggagacggccaccatgtccttgaagatctccacctgggaatgggcgttctggcccacggtggcgtcgaggaccagcagcacgtcatggggtgcggtctcgtccaccttcttgatggagcgcaccagcttggccagttcggccatcaggtcggccttgttctgcagccgcccggcggtatcgatgaacagcaggtcgtcgcccctggcgcgggactgctcgacggcgtcataagccagaccggcggcgtcggcgccggtttcgcgggcgatgaccgggcaatgggtgcgctcgccccagaccttcaactgctcgacggcggcggcgcggaaggtgtcgccggcggccagggtgacgttgaggccggcatccttgtaggtcttggccatcttgccgatggtggtggtcttgcccgagccgttgacgcccaccaccagcaccacatggggcttgcgggtggaatcgatctccagcggcttggccacgggggtgaggatgcgggtgatctcctcggccagggtggccttgatttcgtcggaggtgacgtcctgaccgaagcgggtcttggccagatgcttggtcacccgggcggccatggcgacgccgagatcggcggtgatcagcaggtcctccagctcctccagcgcctcgtcatccagcttgcgcttggtgaacaggtcgcccaggccctgggtcagcttcgacgacgatttggccagcccggatttcaggcggccgaaccacgaggcgggctcttcggcggcaggggcggcgggttcgggagccggggcgggggccgcgtccttcttcttgccgaaaccgaagatgctcatgccaattcccccaccagctcatccccgtcaaccgaggtgatgcgcacgttcaatatcgttcccggctcggcggcgcaacccgctacccgcacgggcaggtaatgggcggaatgacccttgccgtctttttcgatcagcacgctttccacgcccccgatccgggtggcgaggaaggcggccatggcggcggcgcccttggcgcgcaggcgggcggcgcgctccttgaccacgtcgcccttgaccttgggcatgcgcgccgccggcgtgccgggacgtgccgagaaggggaagacgtgcagatgggtcagaccggcctcgtccaccagatcgagggagtgctggaacatctcctcgtcctcggtggggaagccggcgatgatgtcggcgcccagcaccgcgtcggggcgaagggcgcggatgcgcgccgccagggtgatgacgtcgcctctcagatgacggcgcttcatgcgcttcaggatggtgtcgtcgccggcctggaccgacaggtggaaatggggcagcagtcgcgcttccgaggcgatggcggccagcaggtcctcgtccacctcgacggggtccagcgacgataggcgcaggcggggcagttccggcaatgcggccagcaggcggcgcaccagttggcccaggcccggcttgcccggcaggtcggcgccataggcggtgacgtccacgccggtcagcaccacttcattgaagccgccggccaccagctctttgatctgctcgacgatgcggcccatgggtaccgagcggttggggccgcgcccgaaggggatgatgcagaaggtgcagcgatggtcgcagccctgctgcacctcgacgaaggcgcgggcgcggccttcgaagcccgagaccagatgggaggcgacttcgcgcacctccatgatgtcgcccaccacgatgcgttcggccgggggggcggcgaagatgtcgggctgcatcttctcggcattgcccaggatctggtcgatctcgggcatggcgtcgaaggtctcgggatgggcctgggcggcgcagccggtgaccacgatgcgggcgtcggggcgttcgcgccggatcttgcggatggcctgccgcgcctgcctctcggcctcggcggtgacggcgcaggtgttgacgatcaccgtctccacgccgctttcggtggccttggcgtgctccttcatcacctcggactcataggcgttgagccggcagccgaaggtcaggatggtcggaggggtgttgctggtcaatgtttgtccctcagacgccgggcgggcgcgggcgcccttggctcctccgctacgctccgggtcgctcaacgctcccgcgctcggcttcgcctcgctcatggaagcagggacgaatccagcgtcccggtaaaggccaccgccaccgggccggtcatcagcacatggccgtccttcagccattcgatggtaagggtgccgccgtccaggatgatctcggccttgcgggggctaaggccgcgccgcgccgccgccaccaatgtggcgcaggcgccggtgccgcaggccatggtgatgccggcgccgcgctcccacacccgcatgcggatgcgacccatctcggcgtcgggaggcgtcagcacctgggccacctcgatattggcgcgctcggggaacagggcgtgatgctccagcccccgccccaactgggcaaggttcacggcttcggcgtcgtcgacgaagaacactgcatggggattgcccatgctgacgccgacgggatcggccagcggcccggcggaaatgcccagatgcagggtgtcgaccgcctcggccaggggaatctcgcgccagtccagccgtgccggccccatgtccaccgccacctgatgggggccacgcgattcggcatccagcaggccggccttggtctggaacaccaccttgtcggcggcgatttccttcatcagcagccaggcgacgcagcgcgacgcattgccgcaggccgccacttccgagccgtcggcgttgtagatcaacatggtggcgtcggcgcaagggtcggtggcctgggtcatcaccaccagctggtcgcagcccacgccggtgccgcgcgacgcgatggcgcgcacccgctccggggtcaggtcaagggcgcgcgcacgggcatcgaggacgacaaagtcgttccccaggccatgcatcttcaaaaagggccaggctcgatcgctcatgatggcgttatatggggcggcgggcatttgagtccaggttttcgaccacatggcaggttgtccgggacggcctcggcccctatcctggcttcatgatcgagtccatgaacttttccatcctgatcgtctcggggctggtggcgctcagtatcttctccagcctgctgtcgttccgcatcggcgcgccgctgctgctggtgttcctgtgcgtcgggctggtggcgggcgagaacggactggggcgcatcaagttcgacgatgtccgcgccgcctatatgatcggcagcatcgccctggccatcatcttgttcgattccggctttcacaccagcctcaaggccttccgcgccgccttgtggccggccatggccatggccaccggcggtgtggtggtcaccaccacggtggtggcggtgccggtccattatctgatggggttcgactggctggaatcggcgctgatgggcgccattctcagctccaccgacgcggcggcggtgttcttcctgctgagggtcggcggcatccatgtgcgcgaccgggtgcgctcgaccctggaagtggaatcgggcagcaacgaccccatggccatcttcctcaccctggcgctgatcgggctgctggtggccaagggacccatctcgccggtggccatcggcatggatttcatcaccaagttcggcatcggcgcgccggccggcatgttcggcggcgggctgatcgtcctggcggtcaacaagatgggcttcgagcggggcttgcagcccctggcggcgctcagtctggccatggtgctgttcgccgccacggaagaactgcacggcagcggcttcctcgccgtctacatcgccgggctggtggcgggcaatgcccgcatcaacgcgcccgagaccatgcgccgctttcaggacgggctgacctggctggcccagatcgtcatgttcctgacgctcggcctgttggcgacgccggcggagtttcccgccttcgcctggcagtccctgggggtggcgggcgtgctgatcttcgtggcacggccgctggcggcgtggatctgcctgctgccctacggcttcaaccgcaacgagacggcctttgtcgcctgggtgggcctgcgcggctcggtctcggtgctgctgtccatcgtgcccatggtggtggggctgccccatggccgggattatttcatcctggccttcctggtggtgatgatcagcctggggctgcagggctggaccatcggcgccgtggcccgcttcctcggccagatcgtgcccaagcgcatcgggccggtggagcgcatggaactggaaatccccggggcgcgccatgagttggtgtcgtacggcatcgtcgccgattccctggtggcgcgcggccatcgcctgccgcgctgggccgagccctccctggtggtccgggacaagaagtcctattccactcacgccgccaagggcttgaagcccggcgacacggtgttcctgttcgcccggcccgagcgggtgccccatctggaccgcctgttcgcttcggccgctcccgccgccgaggccgattcgcgcttcttcggcgatttcgccctggagccgggtgcccatatgaaggatctggccctgctttacggcctgccggtggcggccgccgatcacgacatgtccgtcgccgactggctgatccgcgaactggggcacgagccgggcatcggcgaccgcgccggcctgggcgaggtggaactgatcgtacgggccatggattgggacgaccggatctccgagatcggtctggcggtggagcccacccgcatcgacgccccccggctgccggtgttccagagccgcaccgagttgaaggcaatgctcaaacgctggatgaggaaacgcgcatgaccctggtgaagactcaccgtcagctgatcgacgaggccaacgccctgatcaccaccattcccaccaatgaagccatcgcgcttcatggcgatcccggcgtggtcttcgtggatatccgcgacgtgcgcgaactggagcgggaaggcatgatccccggcgccttccatgcgccgcgcggcatgctggaattctgggtcgaccccaccagcccctattacaaggaggtgttcggccaggccaagcgcttcgtattctactgccagtcggcgtggcgctcggcgctggccacgagggcggtccaggacatgggcctggcccccgtcgcccatgtggagggcggcttcaagggctggaaggacgcaggcgggccggtggggcccaagcccgagcacaagaagggggggtgatcaccccccgcaggtgccgcagcaggtgtcgctgtcataggtcagccgcgccaccagatggcgctggccgtcgcgggccgggaagaactggttgaagaccatggtcaggcccttgggcagcggcaccttcaggccggtcatgcgggccgagcgcgagctgttgtactggtagccgtcggactcgtcgcacaggccgaaggcggcgggcagcagttcggcgcagaacgacagcgggacctgacgggcgtcgacgacggtgccggtggccagggtctcgatcaccgcgctctcgccatcgacccgaacctgcaccacgttggcgtgggcggcgacggcgttctccagcagggtcagcatctcggtctgggcatccagggcgggggcgatcacgttcatggcggggctccttgggcgggtggcgcagcaaagcagctttgccccgtcggccacattgagcccggtcaagcatcccccttccgggacggcggcgggcgtggttatatattcccatggagattcgcccatgaccggtgaaaccagtgttcgcgtgctgatcgagggccgggtccagggggtctggttccgcggctgggtggtcgagcaggccaccgcccgcaagctgtcgggctgggtgcgcaatctggtggacggccgggtcgaggccctgttccacggcccctcccatctggtccgcgacatggtcgaagcctgccaccaggggccgcccgccgcctggtcacccgggtggagaccgaggggtcttccgaattgccctcggcgggctttcaccagcgcccgaccgcctgatcatgaaattctcacgccgccaaatcctagccggagccgccgccatgaccgtcgccaaagctgcccaatccgctcctcaaggggcgcgccagttccccaaggatttcttctggggggccagcaccgccgcctaccagatcgagggcgcctatgacaccgatgggcggggcatgaccatctgggacaagttcaccgccgacggcaagatcatggacggcagcagcgccaaggtggcctgcgaccattatcaccgctaccccgaggacatcgccctgatgaaggcggcggggttcaacgcctaccgcttctcactggcctggccgcgcatcattccggcggggaccggggccatcaacgccaagggcctggatttctacgaccggctggtggacaagatcctggaagccggcatcaagcccatggcctgtctgtatcattgggatctgccgcaacccctggaggacaagggcggctggcaggggcgcgatatcgtcggccccttcgccgaatacgcccgcatcgccaccaagcgcctgggggaccgggtcaaggactggtacatgctgaacgagccgaatgtggtggccatcatcggctacggcatcggcgagcatgcgcccggctacaagctgggcgaggacggcatcctgaaggccctgcaccatcagaacctggcccagggcaccgcgctgcgcgccatccgggccgagcattccgacgcggtgctgggcacggtgatcaacctgcagccctgccgctcccaggatgacgatcccaagaaccgcgccgccgccatccgctgggacgcggtgtggaaccgggtgccgctggacggcgtcatgcgcggcgccatccccgatgtgctggccgagaagatggcccatatcgtcaagccgggagacatggagaccatcaagttccccatcgacatgctgggcatcaactactattcgcgcatgaccatgaagcacgaggaaggccatcccttcgacgtgttctggggcgacgcccattgcgaccgctggaccgccatggcctggccggtgcagcccgacgggctttacgacctgctgcgcgagttcaaggagctttacggcaatccggcggtgttcatcgccgagaacggcgccgcctatgacgacgtggtcacccccgacggccaggtccacgacgccgagcgcgtcgcctttatcagggatcacgtctccgaggtggcccgcgccgtcaaggacggctgcaacgtcaagggctacctggtgtggtcgcttctggacaatttcgagtgggcctatggcctgtccaagcgcttcggcatcgtgcgggtggattacgagaccttaaagcgtacgcccaaggacagctacaagtggttcgccgaggtcatcaggaccggccgggtgggctgaggaaaagcaacggggcggagggaaaaacctccgccccggttcatatcgggtgtcgccgaggtcaggcgacgatcttcttgtcccgcaggaaggcggcaatcttgccatcctcgtggcggatatggtccttcagccagccggcgacgaactggaacagctggccgttggcgccgtccttgccggtctccacggcgcgcttcaggccctcgaacttgtccatgaactcgcggtgacggcggcgatgctcgtcgatgccgggataggcatggcgggtcatcagctcttcctcctccttgaagtgggggacgaaggccgcgggaaccagtcccaggataccctggatggcggcatcgccgttgccgctcatcatctcgccgtagaaacggttgacctgatcgaacatttcgcggtgatgccggtcgatggaggactcgccggtgttcagggcgttctcccactccaggattctcatgtcggccttgtcggcgcgcacctgatgcaggaagcggccgacctcgccgcgcaggaattccgcctgcttggacaggtcggtggcggattcgctgatctgctcggcggcgtggccggtttcgcgggcggcctgctccaccgaattgatgttgctggagacttccgccgtgccggcggcggcctgttccacattgcgggcgatttcgccggtggcggcggtctgttcctgcaccgccgaggcgaccgaagcgctgatctcgcccatttccgagatgaccttggagatggtgtcgatggccttgacggcattgccggtgccttcctgcaccgccttgatctggctggcgatctcgtcggtggccttggcggtctggttggcgaggttcttgacctcgttggcgaccacggcaaagcccttgccggcgtcgccggccctggctgcctcgatggtggcgttcagcgccagaagattggtctgggcggcgatgtcgttgatcagcacgaccacttcgccgatgcggcccacattgtccgacagggcgcggacctgattggtggtgttctcggcttcctgctcggcgcggttggccaccgcctgcgagcgttccacctgcttggcgatctcggagatggacgcggccagttcctcggtggcggcggccacggtctccacattggccgaggcctgggtcgccgccgaggcgacggtggtggcctgggcgctggtctcgtgggcggtgccggccatctggctggaggcgccttgcagttcggtggcggccgaggtgacggtctgcaccaccttgccgacgctttcctcgaaggtgtcggccatatggtgcagcgccgccttgcggtcggcctcggccttgaccttctgggcctcctgctcggcctgcatcttgtccatcttcagggtgttttccttgaagatctccatggcctgggccatggcgccgatctcgtcggtgcgttcccgcgccgggatatccacggtcttgttgcccttggacaattcggtcatggccccggtcatggccgacagcggcgtgacgatggaccgcgcgatcagccaggacagcagcacggcaaggcccagggcgatgatggcgccggtccaggtggcggtattgctgcgcgccatgccggcctcggtatcggccttctgctggtccatggcctgatcctgggagtggacggtctgatcggccagatcggcgaattggacggccaaagcggccatgtccttgaacaccagcttgtccagggcattggtggcggcggccacctgggtgaaggcgtcgcgataggccttggcattggtctcggcctcggcggccagcctcttgcgctcgggattgcgcagccgcttggtcagggtttccgcctccttgacgaattcctcgatctcggtctgggcgtccttgaccagggcgtcgctgggatcggccaggaacttgatggcattgagccggcccagcagcagcgcttcctgcgccacgccggccagggcggcggcctcgtaatcgccatcgtccatggcggtcttcatgatctggctcaggtccttgcgggccgcgacgccgaccacgttcatgcgcttttcgaccagttccagcttggccttgcgcaggtcggccaccttgtcgaagccggccatgtatccggtaaagagctcgcccatcttggtcagattggccttgcgggtcggatcgacggtcgcattggcggcctcgggcaacgtcttggccatgcccggctgaatcttgcgaatctgctcgagagccttgggatcggcgttgtcggcaaagatgatgacgttgcggcggatattggcgaaatcgcccttgaggctcagcactctttgggcgttgtcggatacgccggcatatctgtcgatctgagccttggaggagcccaaggtggtgatggactgcccggcgagcaccagcaacagcaggacgatcaggccgaagccagcataaattcgtccggagacgttgagattgaacattgtcggacccccaaaacagcgtgtctgccgaagcgcatataccggccggcgaaatatagctcttcagtatgatggtcttagggcggaagtgtaatccgtatagatgcgtatgctcggtgtatcataagttgagaataagacatatgccccggtcgcaaatctttcaagccggaaggcctaatctctatcctgggtgtggctattggccggccattagtgccgtatgattgcatccaaagctggtggtcccatcatttcggggggtaggccgccggctttgccgcaccgtggcggcgggggatggcggggcggcgccagtagccgccccgccccccggggctattcggccgcaggctttgcttgctgcgcctgggcgggttcggtgtggtagatctcggcgccgtcattgacgaacttctcgctcatctcggccatgccctgctcggcggccgcgaagtcgcggacctcctggctgatcttcatggagcagaatttcggcccgcacatggagcagaaatgggccagcttggcgccctcggccggcaggtgctggtcgtggaaggccagggccttctccgggtccagcgacaggttgaactggtccttccagcggaactcgaagcgggcgcgggacagggcgttgtcgcggacctgggcgccgggatggcccttggccagatcggcggcatgggcggccagcttgtaggtgaccacgccttcgcgcacgtcctgcttgtcgggcaggcccagatgctccttgggggtcacgtagcagagcatggcggtgccgaaccagccgatcatggcggcgccgatggcgctggtgatgtgatcgtagcccggcgcgatgtcggtgaccagcggcccgagggtgtagaacggcgcctcgccgcacagctcgatctgcttttccacgttcttcttgatcttgtgcatgggcacatggccgggaccttcgatgatcacttggcagtcatgggcccaggccttgtgggtcagctcgcccagggtctccagctcgccgaactgggcggcgtcgttggcgtcggcgatggagccgggacgcaggccatcgcccagcgagaagcccacgtcataggccttcagcagttcgcagatctcttcgaagtgggtgtagaggaagttctccttgtggtgcgccaggcaccacttggccatgatcgagccgccgcgcgacacgatgccggtggtgcgcttggcggtcagcgggatgtagcgcagcagaacgccggcatggatggtgaaatagtccacgccctgctcggcctgctcgatcagggtgtcgcggaagatttcccaggtcaggtcctcggccttgccgtccaccttctccagcgcctggtagatcggcacggtgccgatgggaacggggctgttgcggatgatccattcgcgggtggcgtggatgtggcgtccggtggacaggtccatgacggtgtcggcgccccagcgggtcgcccacaccatcttctccacttcctcgtccaccgaggaggccacggcggaattgccgatattggcgttgatcttggtgaggaagttgcgcccgatgatcatgggctcggcttccgggtgattgacgttggccggcagcacggcgcggccgcgcgcgatctcggcgcggacgaattccggagtcacctcgtcggggatgtcggcgccgaaatcctcgccatcacgcaccacggcggccttcatctcggcccgcttcatgttctcgcggatggccacgtattccatctccggcgtgatgatgccggcgcgggcataggccaactgagtcggcgccttgcccggcttggcgcgcagcggacgcaggccggcgccggcgcggtcgaacaccggcacgccgatggtctcgcccggcttcaggccgtcatcctcgggcttgtgggcccggccctcgtaatgctcgacatcgccgcgttccagaatccactgctcgcgcaggcgcggcacgcccttggtgatgtcgacctgcatggaggggtcggtataggggccggagcagtcatagacccgcaccggcgcctcgcccgagccgggcgtaaggtcgatctcgcgcatggccacccgcacatcggggcgcgagccctcgacataaatcttgcgcgatcccggcagggggccggtggtgatcttcagggtggtctcggacatgggcgtgcttcctcgcttgggcggcgggcagggtccggacgagtggaggcggaagcaccgatgggttccgatcccttcgccggaatgacccggatcaggttccaagggtcgccggcgcctgtgaccggcctctcagccccttgaacggggctccccttcggaaagatggcaaagagtggtcttttccgggcgcgaaagtcaagctttgcaagaccttactttgcggcggggttccccttgcttcgggaccagcatgacatgcccttggcctgggccgagccgcagaaggcctccaccgcctcggccgggccgaccgccaccagccggtaccagcggccctgtccttcgacccggttggcgacgatctcgggcgatagccccttgaggcgcagccgtttccaatcctgctcggcggcggccttggtgcggtacgagccgatctgcatgcggaccacggccggttccgcggcgggcggcggcggcgggagaggggcggcagccatcgcttcggccggcgccggggcggcggcaacggcagcggcggcgggccgggcctcggcggccagacgctcaagctccgccttggcggggaggtagccggcctctgccgccttgcccagccgcctcatcccttcggcctgatcccccggcaggccggggccaccccgcaggtagagcatgcccagattgtactcggcgctgaccactccggcatcggcggccacctgataccaggcggcggccatgtggccgtcggcctccacgcccagaccctggcgataaagatggcccaggttgcgggccgcctcgccgtcgcccagttcggcggcgcgctgccattggcgggcggcttcggcgtgcatgtcctcgtggaacgccgccagaccgccgtagaaatagtggtcgcggatggtctgcatgggcggcggcgcgtcggcgcatccgcccagcggggccagggcgagaaatgacgccaggacgagaataagccgagcttgtgtgcaaggattcacagagggccatccgttgaagagtgtagtctgagatggaaggccgtctgcggccttcgaatcgttttcagggtgctgcaatgcctttagaccttaccgactgggcgacgttgttggaagttctggacgggatcaaggctccgtttcctccgctgaccgtgctggcgcaaaagcacccgaacgcaagcgagggggcgcgggtcattcccttcatgctccccgtcgtccctcagccggccgccgattccgccaggccccggtcccaatagggttccgggccgaagctcgtcgccagatggtccacgaaggcccggaccttgggcgacaggtggcggccgtggggatagaccgcgttgagcgatgaatccagcggcacataggcctccagcaacggcaccagacggccggcgcggatgtcgtcgcccaggaagaagctgggcagcagcaccacccccaggcccgccagcgccatgtcccgcagcacgtcgccgttatcggcgtggaaccgtcccctgacctccacctggacgggcttgccgtcgtcgccggtgaagcgccattccgattggacccggccgccatgggtcaggcaatcgtgggcggacagctcttcgggacggcggggcgtaccccggcgctccagataggcgggcgaggccgccgccatccgccgtaccggcgcgaggcgacggacgatcaacgacgaatccgccagccgcccgatgcgcaccgccagatcccagccctcttccaccagatccacgtgccggtcggtgaagcccatctccagttcgatctcgggatagcgttcgagaaagcccggcaggcaggccgacagatggccgatgccgaaggacagcggtgcgctgacccgaaggcggccgcgcggcaccgcctgcaggtggctgaccagcaggttggcttcgtccagatcggccagaatgcgctggcaacgctcgagataggcccgcccggcctcggtgggcgacagggaccgggtggtccggtgcagcagccgcacccccagatcggcctccagtgcagagacctggcggctgatcatggacttggacaggccgaggcggcgggccgcttcggaaaagctgccggtctcggccacccgcacaaaagcgatgatggtgtcgaagcggggcgtcatcggtgtctcccaggcaacaatctgtttagatcatcatgaattgttgtggctccgtggcaagggtaatctggtctccattggaggagagatcccccatcggagaagagatcatggacgtcaccaccttgttcctgtcccacgggtcacccatgatggtgctggaggacacgcccacccgccggttcctgaaggaactgggccggcgcttgccccgcccgccggcggtgatcgccgtttcggcccactggcagaccgccgagccggtgctgggcttcgccgcctggccggacaagatcaacgacatctacggcttcccgcccgaattgtaccagctggcctatgccccgcccggggcgcccgaggtggcggcgcgggccgccgaccggctgggcgccgcctgccgccgcgatcccggcgccggcatcgaccattccatctggtcggtgatgagcctgatgtggcccgaggccgacgtgccggtggtgcccatgtcggtgcagcccgaagccggggcgtcgcaccattatttcctgggtcggcggctggcgcccctggtggccgagggtgtgctggtgatcggctcgggcgccgccacccataatctcgaggactacttccgccgcaagaccaccgaggcggtcgaacccgccgtcgtcgagttcaccgactggctggccgcgacggccgagcggggcgatgtggcggccttgctggattaccgcgtccgcgccccccacgcattgcgcaaccatcccaccgaggagcatctgctgccgttgttcgtcgccctcggcgcctcggctcacggcgaggcggtgcgcctgcaccacgacgtggattccggcgtcctggccatggatgcctacgggttccggtgacgccccgatccatgctaggcttgaccgaagttaaacaggggaccgggcatggcctatctgcagtggaccgagaatctcagtgtcggcattccgcgcatggacgagcaccacaagaaactcgtcgagctgatcaaccaggtgttcgacgccatgagcggcgacgccgcctcggccgtggacagcgtgctggccgacctgctcgactacacccgctatcacttctccgaggaagagaagctgctggccgcctgcgcctatcccgacctggccgagcaccaagaggtgcatcgctccatggtcaaggaggtgctggacatgcgcagccgccacctggccgacccggcctcggtgaccgcgtcggagaccctggacttcctgtccaagtggctgatgcgccacatcatcggcaaggatctgcgctatcggccctatgccgagaaccatccgctggcgtgagccttcggcatccatgatccggcccattctcgccgtgatggttctgtcactgcccctggcaccagccggcgccggagagacggcctgtgccgacagcccgatgcgggtgggggagtgcttcaccgttcatggccggctgactacctgcgggggtgtccccaccgcccggatctgggtggtcggaaccaagcgggttctcggtgtggtggccgccaattcccatccggcgggagaccatatcctgcccccgtccctggatcgggccatggcctcggagattccgtgttccagggcggcctatggcgacttcgccgtctgccccttaagcccggaccagccgggcgtcatgcgccgcgtctgcctgacggatgcccgcaagctggtgttcagggactggtagtaccgtcgtccttgcccgccggctcgtaaagctggcggacgatgaacagcgggcgacccttgacctcgtcgaacacccggccgagatagtcgccgatgatgcccagggtcagcagctggatgccgcccaggaacagcaccgacatcagggtggattcatagcccggcacgtcgatgccccagatcatggtgcggatcaggcggaagacgatgtagaggaaggccagggacgagaccatggcccccacccagccccagacgcgcagcgggaagttggagaacgaggtcaggccgtcgaaggcgaagcccagcagcttcagcgaattgaacttggtggttcccgccgcccgttcgccctggtgatagatgatctccgcttggcgatagcccacccaggcgaagatgcccttcatgaagcgcgagcgctcgggcatctggttgatggtatcgaccaccttgcggtccatcaggcggaagtcgcccacctcgcgtggcaggcggacgtcggacaggtggtcgaacacccagtagaagcccttggcgaagatcttttccgacaggccctggccggtgcgggcgtcgcgccgggcgaacaccacctcgtagccgtcccgccacttggccagcatgtgggcgatggcctcgggcggatgctgcaggtcggcatccatgggcaccaccgcttggccccggctgtggaacagcccggccgacaatgccttctccttgccgaaattgcgcgacagatcgatgactctgaggcgcgactcgcccttttgcaggtccagcagccggtcgagggtgtcgtccctggatccgtcattgatgcagatgacttcgaatgagacgcccagcccctccagcgccggcagcagccgggcgaacagcaaaggaacattttccccttcgttgtagcaggggatgaccaccgacagggtgggagcagaattctgattgacggccgctgtcatggggactgtcccgattgatcgatttccaagcatggcactacctgcactttggggcaacgcagctttgcgggcatttttatctctgcagacttgcccggaacgctggtccatggcagggtccgcaccatatatcgaccgttccgaggccttgtcccatgatcaagtccgtgctgttgcccctgatggtggctttggggcttatggccgcttccgaagcgcgcgcccatgccgtcctggtggaatcctcgccgccggccgaggccgaggtggtgggtgccaaggtggagttccatctgcgctacaacagccgcatcgacgcccggcggtcgcgcctggcgctcaaggggccggcgggatccaagaccctgccgccgcagcaaggcgaaaacgaggccgaactggtcgcccgcgtcgagggactggcgcccgggcgctatatccttttctgggacgtgctgtcggtggacggccatgtcagccggggccaggttccctttctgaccatcgcaccttaggggacgtcgccatgctgaccactctgcctcccgacatcctcgcctttttcgccgtgatcctgcgcggtctccaactgaccgcccagtcggtgatcctgggcggcgtgctgttcctgctgggcttcacccggcccatggcgctgaagctgggcggccgggccgccgccctggagcggaccggcatggactggaccgccaaggccggcttcgccctggtcgtggtggcgggcctgtccatctttgccagcctcgctcaattggtggccgggctggagattcagcccgccgacgccatgggcgccgatttcgtccagtggaccctgatcatggccgttgccgccttcgccctggcggtgacggcgcgcatgggggccaatcccgcccaagtgtcgtccctggccctgctggcggtagtggtgctgggcgcttcggtgatgtccagccacgccttcgcccgggtggaagagcgcaattactacatcctggccgacgccctgcatcaggccggcgcgtcgctgtggatcggcggcattcccttcatgctgctggccctttccaaggtgaccgggtccaaggaccgcctgatggtgggcatgcgcttctcgcatctgttcaccggggcggtggggctgctgctgctgggagccggcatgctggcttggggctacatctccacgcccggcgccctgatcggcaccgcctacggcatcatgaccggggccaagatcatcctgctgtcggtgctgctgctgctggcggcgctgaaccgcaagtccacccggtccgaggccgaggacaagggacagttccgtctgcgccgcttcgccgaggtggagatcggcatcggcatcaccgtgctgatgatcgccgcctccatggcctcgcagccgccggcggtggaccagctccagtaccaggcctcggtgggcgagatcgtcgagcgcatggcgccggtgcgtccgccccgcgtggtcagcccgccgtcggagcacctgaccctgggcgagaagaccgccgccagcgacacggccgacaagatgtggtccgagttcaaccacaactgggccggcatcttcgtcttcgccatgggcctgggcgccatggccaaccgcatgggagtgaaggcggcgcggcactggccgctgctgttcctggtaatcggcggcgccatcatcatccgctcggacccggaaagctggcccatcggccccaggggcttcttcgagaccctggccgaccccgaggtgttccagcaccgggtggtgggattgctgctgttccccttcggcctgttcgaatgggcggtccgcaccggacgcctgaagagcgagcgcgccgcgctgatcttccccatcctgtgcgcggtgggcgccgggctgctgctggtgcacaaccacaccctcaccgacgtcaaggagcgctttctgatcgaattcagccatattcccatgggcctgttcggcgtcctgtcgggctggctgcgctggctggagatccggggcgacgggcgcgccaagcaagttgcggggttgctgtggcccctctgcttctccatggtgggcgtgctgctgatgttctaccgggaattgccgtagcagccgggggaggagcagggaccatgcgcaaccgcatcactatcctgctcctgactctggcgaccgtggcgctgtcggcggcggcggccggcgtggcgggctattggtacatcaagcccactgtgatcaccctggcggtgtcccccgatccatcgcccgaataccgcttcgcccgcaagctggccgatgtgctggcccagaatcgcgcctccatccgcctggaactgatgattgccgagagcgggcagcaggccatggcccggctgtcccagagcgatgccgacctcgccctggtgcgcagcgacgaccgccggattccgcccatggcccggtccgtggccgttctggaagagcaggtcctgctgctgatcactccgtccaagagcaaggtcaggtcgctgggcgatctggcgaagcggcataccctggtgatggaccgcgacggccgcaacgaagccctgttccgccgcctgatggagcagtaccgccacgatggccgccccgcctcggtcactgtcgtgccgcccggaacgcccctggccccacgcctggggccggggggcgggatcgatgccgccatcctgctcatgccgctgtcacggctgtcagggccggaggatttcgcggccatggaacgggacttcaagggcttttccgtccaggccatcaccgacgccaaggcgctggagcgcaagattcccggcctttacgccgaaaccatcgaggcgggattgctgtcgggctcgccgcgcattcccgacgaggatctggacacggtggcggtgcagcggctgctggtggctcgcgccaagctgcccgagcaacacgtggtggaggtgatgcgcgccctgttcgagaacgggcgccaactggcggtggaacagaccttcgccacccgcatcgagccgccgtccaccgagaaggcggccctgatcgccatccatcccggcgcccagcaatatgtgagcggcgagatcaagacgctgttcgaccgctacgccgacgtggtcttcattgggctctacgccgccggtatcctggggtcgggcgcggtcgccctctacggcatggtgtttcgccgcgcccccgtccacgccggtagtcgcgcccataccctggcggcgctgcgcgagcgggcgcgggccgcccgcgatggccaggaattggacgccgtcgagatggagatcgaggccgttctggatggcgtgctgtcgggcctggctgacggggccatttcgccacgcggcctggaaggcttccgactggcctacgacgccgctcgcgacgcggtggccgcatcccggcggatgattgctcacccaaccacgtagctgagccgcaccacgccgttgatataggtcttggcccccagcagggtcatacggtcgccgcggtcgctgggcaggaacagcgggcggcccttgcccagcagcaccggcatgatgaacaggtcgaaatgaccgatggcgcccaggtcgagaaaggcgcgcagggccttggcgccgcccgccacccagatgtcgccgtccggcgaggccttcaactcggcgaccagttgggcgagatcgcccagccagggctccacattatcgggggcggtctccatggagcgcgaggtcaccacgatgcagcgcttgtcgccgtggggccagtgccccatggcgtgcaggtgctcgtaggtggtgcggcccatcaccaccgtgccgatgtgttccatgaactcgtcgaagccgtaatcgatggcgtcgaacggcttcagccaggcgatggacccgtccgaatcggcgatgtagccgtccaggctggcggcgatataggcgcggaagccggcggccattccctattcggccgccttgggcaggtaggccgagacgtccacggaatccacctgctcgggccgcaggtacttttccgcgtagtccttccagacgcccgaggtcaggaacaactcccacaattccttgtcgatgtgctggtccttgaccatgaacgacatgatcttgagggattccgacagggtcttgggcttcttgtaggggcggtcggcggcggtcagcgcctcgaagatgtcggccaccgccatcatgcgagcgggcagcgacatctcttcgcgcttcaagcccttgggatagccggtgccgtccatcttctcgtggtggccgccggcccactcggcgacgcgggccagattcttggggaagggcagggccttcagcatgaagatagtctggacgatgtggtcgttgatcttgaaccggtcctctgcggtcagcgtgccgcgcccgatggccagattgtacagctcgcccagattgtagcggttctccagcggcttcatcttgaagccctcggcgtcgtagcgcgccgtgtccacgttgatctcgtgggggatgacgtgccagtccttgtcggccagcatcttctcggtgaccggtggcttgggctcgtcgccggtgcgccggcgcatttcgtccagggacagccccatggtgtcgtccagcgtccgcacccaggtgcgctcggcgatggctttcagccgctcgaccttgtcgggcgccatgaactcgccgcccacgttgctttcggccacgaaggcgaagtcgtcgtctagggcggccagttccgcgtccatgcgggccttcagggtctcggacttctcctcgccggccaccaggccttcaaggtaggtgatcaccgcgtcgcgcttggccacctcgaagcgcatacgcacttcgtgaatgcggttgtagatggtctccagcttggtggccttgtcgacgatgtattccggcgtggtgaccttgccgcaatcgtgcaggccgcccgccacctccagctcgtaccactcgtcttcggtcagggagaagtcggcgaaggggccttcggtctgatcgcacgccgcctgggccagcatgaaggtgatggccggcacccggtggcagtgcccgccggtataggggctcttggcgtcgatggagccggcgatcacctgaatgaagctcttgaacaggttcttctgggcctcgatcaggcgctggttgtccagcgccaccgccgcctgggaggccagagcctcgatcagcggggtgatgtcggggccgaactccacgatgcggttgcgaccgtcgcgggcgttgatcagctgcaggacgccgatcacctcgccctcgtagttctttagcggcacggtgaggaaggatttggagcggtagccggtcttggtgtcgaaggccttggtgccgctgaaatcgtatttgtccacgtcataggcgtcggcgatattgaccgtctggccggtcagcgcgcacgagctggacacgttcttgtggttgggctggccctggtcgttatataggcgcagtggcgggaacgggatcggcttacccgtggtgccgcccatggcgatgttcagcgtgtcgttgagcatgatctcgaagcggaggccgtccttggcctcggtcatcaggtagagcgtgccgccgtcggcgttgcacatgctcttggcgcccgagaggatcttctccatcagccggttgtgattgcgctcggccgacagggcgatgcccagctcgatcagtgtccggtagcgttcttcttttttatgtaccgaagccataggcagccatcccccttagggataatcaagcggtaaccctacccaagcctacgccgaaacgacccgggcgtgaagtcgggtgaaagcactacatattatcacatttgtgtcggatgattatctggggcatctcggtcttgacgacaaggcgggatcgtactcccctgggggccggaccacaggagagcccctatgccctacgaatccctgcgcgacttcatcgcccgcctggaaaaggccggacggctgaagcgggtgagcgcgccggtatcgccccatctggaaatgaccgagattcagacccgcctgctggccgagggtggcccggcggtgctgttcgagaatgtggtgcgcgacgatggctcgaaatattccatgccggtgctggtcaacctgttcgggacggtggagcgggtcgcctggggtatggaccgcgaaccgcatcagctgcgcgaagtgggcgagaccctggccttcctgaagcagccggaaccgccgggcggctggcgcgaagccctggagatgctgcccctggccaagaccgtgatggccatgcggcccaagacggtgggctcggcgccctgccagcaggtggttctgaccggcgatcaggtggatctgtcccagcttcccatccagggctgctggccgggcgagccggcgccgctgatcacctggccgctggtggtgacccaggggccgaatcccgacggcgacaagcgcgataatttcaacctcggcatctaccgcatgcaggtgacggggaagaacaccaccctgatgcgctggctgaagcaccggggcggcgcccagcatttccagcgctggggccaggagaagcgccagcccatgccggctgccgtggtgatcggtgccgatcccggcaccatcatcgccgccgtgacgccggtgcccgagaccctgtccgaataccagtttgccggcctgctgcgcggcaagaagctggaactggtggattgcaagacggtgccgctcaaggtcccggccgaggccgagatcgtgctggagggccacgtcatgctggacgagcacgggccggaaggcccctacggtgaccataccggctattacaactcggtggaggagttcccggtcttccgcatctcggccatcaccatgcgccgagatcccatctacctctccaccttcaccggacggccgccggacgagccctccgtgctgggcgaagcgctgaacgaggtgttcattccgctgctggcgcagcaatttcccgaaatcgtcgatttctggctgccgcccgagggttgttcctaccggatcgccgtggtttccatcaagaaggcctatcccggtcacgccaagcgggtgatgttcggcatctggagctttctcaagcagttcatgtacaccaaattcgtcatcgtggtggacgacgacatcgacgcgcgcaattggaaggacgtcatgtgggccatctcgacccgcatggacccggcccgcgacatcacggtggtggagggtacccccatcgactatctcgacttcgccagcccggaaagcggcctgggcggcaagctgggtctggacgccaccaataaatggccgccggaaacccaccgggaatggggcgagaagatcaagatgagcggtgacgtggtcgaccgggtcagccagcgctgggccgaatacggattgccgggatcgggaaagcccatctggcgataggcatattggggactactccacctttcatacatatacgggcgtggtagtgattgagcgctaaggtataatcctcccccagggatcgggcctgttgggggagactgatcaatgcgcctgcgcatcgtgctggcagccgccgtgctggcggcctttaccatgttgatgtccgtcgcgccggccatggctggctgctcgggggagaccatccgtccggatctggcggaccgttggaaggatgccgccggcaagccgcgctggcccaacgaggattggagcggaggcctcaatgtcacgattctgctgctcccgggcacggtgatcgaccggttcggctgcgacgacggcaatcgcttcagcccgcaggggacgccgttcgccgccagggccttgccctatgactgcagccgggagtcttatagcagctaccgggtgctccggccgtttccggtcaagtcggccgaggctcagggatggtttgggctgcggggtggcgccgtccaatatcgtaccacggtcagcgccagagagttgctggcggacggtaccctcgaaccgatcgagtccgcccgcccgtcctgcgcctgactctttaagagaaactcttttcgaatacaatgtgaattggttgtgattgcgtgacacacatcgacgattgagtcattctctccccaccaacaggggagagaatgacatgcgcgtcccgacgcttcttgccgccgccttcgtgctggttctggccgcaatcgcccccgcccgggccgattgcaccgcaccggaaatccgctccgacatcgccgcgcaatggaaggacggcaatggtaatctgcgctggccgcccaatgacggggcggccggggccatcacgccggtggtgctggcgcccggcatgatcctcgaccgtttcggctgcgagggcggcaattacttcagccccaggggcacggcttttgccgcccgggcgctgccctatgtctgcgccaccgcgccctactacacctatcgggtgacgcggccgctgttggcctggaccgccaaggcggcgccgtggttcgaccagaagggtggcgccacccagttccagaccgatgccagcgtggcgcagcttctggccgacggggtgatcgaggcggtcaaggccgaccggctggcctgcggcaagtagggctcagcggcgttcggcgaaaaagcggctgagcagactggcgctccgacgttcctccagcccgccatagacctcggggcggtggtggcaggtggcatggtcgaagaccttggccccgtgctcgacgccgccgctcttggggtcgtaggcgccgaaatacagccggcggatgcgggccagggaaatggccgccgcgcacatggggcagggctccagggtgacgtagaggtcgcaatcctcgagccgcttgtcgcccaggaaaagcgtggcggcacgcagcgccagcatttcggcgtgcgccgtggaatcgcccagttcctcgacgcggttgcccgcctgggcgatcacctggccgtccttgacgatcaccgcgcccaccggcacctcgccgcgggcgctggcggcttcggcctcggccagggccagggtcatgaagccggggccggacactagcgcttggccgccaccagatcggagcgggccatgcggcgcaagctgatttccagccgggcatcggccttggcgatctccatcagggcgtcgcgggtgaagtcgatatgggcctcggcggcggccttggcggcgtcggggtcgccggccatcaccgtctgatagacggcacggtgctgctccagcagcagttcgcgcacgccctggcgctgatagagcttggcgcggttgtagaacacgtccttgcgcagcatgtccgacagcgaacgcatgatgtgcagcatcaccagattgtgggacgcctcgtaaaccgccagatggaaatcggcatcggtctccgcttcgtcgctggaatcgtccttctggtgggcgatctccatcttctcgaaacattcgcggatcaggtcgcggtccacgtcggtgccgcgcagtgccgcgaaataggcggccgagccctcgacgaaacggcggaactccagatagtcgaaggtggtctccggccgcgacgccagggccgagtacaggggctcggtaaagccctcgcccagcaatggcgcgacgaaggtggcgccgccgcgccccgacttcagcaggccgcgcttttccagcttttccagcgcctcgcgcaagctgggccgggacacgtcgaaacgcagggccaactcgcgctcggccagcaggcgctcgcccggcttcaggctgccctccaggatcagctgttccaggtgatccgcgatggtgtccgccagcttggcgggccgaatcggttcggtcatgtctcgccctcgatctacccgccctgtctagccacccttccgggtcgtgtaaagacggcagtgagccatggtagcctgatcgacagtgtttacaacagtggtaaaaagttttatccagcgacacgtcgtcgataaaaaggatgaaccatgatcccctccgcctcgggcaagcctcctttcgccaagctgctggtcgccaatcgcggcgagatcgccatccgcatctgccgcgccgccaccgagctggggctggccacggtggcggtgtattccaccgaggaccgcttcgcgctgcatcgcttcaaggcggacgaaagctatctgatcggcaagggcaagggacccatcgaggcctacctctccatcgacgagatgatccgggtgggcaaggaggccggatgcgacgcggtgcatcccggctacggcttcctgtcggagaatcccgacttcgccgacgcggtgagggcggctggcatggccttcgtcggtcccagttccgacgtcatgcgcctgctgggcaacaaggtggcggcgcgtgccctggcggaaaaggccggggtgccggtgatgccggccaccgggccgctgcccgccgatctggtcgagtgcaagcgccaggcggcggcggtgggctatcccctgatgctcaaggccagctggggcggcggcgggcgcggcatgcgggtgatcgaggccgagaccgagctggaggaattgctggcggtggcgcggcgcgaagccaaggccgcctttggcaatgacgaggtctatctggaaaagctggtgcgccgggcgcgccacgtggaggtgcagatcctgggtgattcccagggcaatctggtccatctctacgagcgcgactgctcggtccaacgccggaaccagaaggtggtggagcgggcgcccgccccctatctcgacggccgccagcgctccgagctgtgcgagaccgccgtgcgtctggcccgcgccgccgcttacgagaatgccggcaccgtcgagttcctgatggacatggagacgggcgctttttacttcatcgaggtcaatccccgcgtccaggtggagcacacggtgaccgaggtggtcaccggcatcgacatcgtcaaggcgcagatccgcatcgccggcggcgcgcccatcggggcgccgggctcggacgtgcccaagcaggccgaaattcccttgaacggccacgccatccagtgccggatcactaccgaggacccggccaacaacttcattcccgattacggccggatcagcgcctatcgcggcgccaacggcttcggcatccgccttgacggcggcaccgccttttccggcgcgctgatcacccgctactatgattccctgctggagaaggtcaccgcctgggcgccgacgccggaagaggccatcgcccgcatggaccgggcgctgcgcgagttccgcatccgcggtgtcgccaccaacctgaccttcctggaagcggtgatcgagcatcccaaattcgtgggctgcgcctacaccacccgcttcatcgacgagacgcccgagctgttcgcccgccaggatcgccgcgaccgcgccaccaaggtgctgtccttcgtcggcgacgtcatggtcaacggcaacccggacgtggccggcctgaagcgccctgccgcgactcaccggcccgatctgccggccttccccgcgagtgagccgccggccggcacccggcaattgctggaccgcctgggagccgaggggctggccaagtggatgctggagcaaaagcgggtgctgatcaccgacactaccatgcgcgacgcccaccagtcgctgttcgccacccgcatgcgcagccatgacatgctggcggcggctccggcctatgcccggctgctgcccggcctgttctcggtggaatgctggggcggggccaccttcgacgtggccatgcggtttctgcgcgaagacccgtgggagcgcctgcgggccttccgaagcgccatgcccaacctgctgctgcagatgctgctgcgttcggccaatgcggtgggctacaccaattatcccgacaacgtggtccggcagttcgtggcccaggcggccgagaacggcgtcgacgtgttccgggtcttcgactcgctcaactgggtcggcaacatgcacgtggccatggacgcggtgcgggagtcgggcaagctctgcgaggcggccatctgctacaccggcgacatcttcgacagcgcccggcccaaatacgacctcaaatactatgtcggtctggccaaggaactggagaagggcggcgcccacatcctgggcatcaaggacatggcggggctggcgcggccgcgcgccatctcggccttggtcagcgcgctgaagcaggagaccggcctgcccatccacttccacacccacgatacctccggcctgtcggcggcttcggtgctggcggcggtggaggccggggtggacgcggtggacgccgccatggacgccatgagcgggctgaccagtcagccgccgctgggctccatctgcgcggcgctggccggccacgagcgcgatcccggcctcgaccagggggcgctaaacggcctgtcgcgctactgggagggggtgcggtccctctacgcccccttcgaggccgacatccggtcgggcaccgccgaggtctatctgcacgagatgccgggcgggcagtacaccaatctgcgcgcccaggcccgctcgctgggcgtcgagcagcattgggactgggtggccaaggcctatgccgacgtcaacgccatgttcggcgacgtggtcaaggtcacccccaccagcaaggtggtgggcgacatggccctgatgatggtgaccagcaacctgaccccggcggacgtgctggaccccgacaaggagatcgccttccccgaatcggtggtgtcgttcttcaagggcgacctgggccagcccaccggcggcttccccgccgccttgcagaagaaggtgctgggcgtcgccaagcccatcacggtgaggcccggtgcggtgctgccgcccgctgatctcgacgcggtgcgcgccgaggccgagaagaaggccgggcgcaagctgagcgatgccgaattggcctcctacctgatgtatcccaaggtgttcgccgatttcgccgcccaccagcggcaatatggcgatgtctccgccctgcccaccgacgtgtttttctggggcatgcagcccggccaggagatcgccatcgacctggaaaagggcaagagcctgatcgtgcgctatctcgccacggcggaagccgaggaagatggctcgcgcaaggtgttcttcgaactgaacggccagccgcgcaccgtgcgcgttttcgaccgcaaggtggcgccggccagggcggcgcggcccaaggccgaagcgggcaatgccgaccatgtgggcgctcccatgcccggcctggtggtgtccgttgccgtccatgcgggccaagcggtggacaagggcgaccttctggtctccatcgaggccatgaagatggaaaccgcggtgcgcgccgatcgggccggcaccgtggcttcggtcgccgtcacccccggggtccaggtggaggccaaggatctgctggtgatcatggcgggataggttccttcttgccttgccgcaaaggatgtggcacttccgctcccgagggcgaatccgtcgggagcggaggagcggtttgcgggggaacgatatggacggggacgccgggaggtcctatcggctgacggtgctcgccctggccggcttggcgctggtcctgctggcctatccgctggcacggattttctgggacttcgagatcgacaataccgagggctggaacgccttcctgcaattgcgcgccatcggtggattgccgctgtatgacaccggctcgccctatttcttcaacaactatccccctctgtcgttttatctggtgggggtcctgtccaagctggtgggcgatgccaatctggccggccggatggtctcgctttcggcgacgctggtggtttgcctggcggtgcgctccatcgtccgctcggcgggggcgtcgcggctggacgggtggttcgccgccatcacctgcgccctgtttttcggctgcctgctcaccgatcacgtgggcaagaacaacccccagatgctggctcatgccttcgtgctgagcggcctggccgtctatctgaagggcgaggccgatgcccgccgcgccgcgctggccgccctgctgttctcggccggagtgctggtcaagcacaacctgatctgcctgcctctgctggtgggcgccgacattctcgtccgcgggccggtgcgcgcccggctggcctattttatgaccggtgcggggatagccgccgccagcggcctgctgctctggctgctgaccggcccggtgttcttcaaccagcttctggcgtcgcgcacctgggacatcacccgggcgtttctgttcaccactgaaatcctcggccagtttcaggcgccaatggccctggtcggactgggtcttctggcgttgcggcggacccgtcccgccgggctggtccttgcctatgtggcctgtggactggccctgggcgcggtgttttccggaggcgcgggaaccgacgtcaacgtcttcttcgacgtctatatcggtctggccatcggggcggggctggtggtgcatctgacgccccagcccatggcgcggccggtgatggcgctgatcatcaatgcgggtgtgctggcctatgccccggcggcgctcggacggttcggggtggagatgctgggcgagctttccgcccgcgagaccctgtttcacgacgacgtggcatatctgaagagcatcagggggacggccctgtgccagtcgcatctgctgtgcctcagggccggcaagccggctttctatgatcccatcaacatgctgcaggccatggtcaaggggcgcctgcccgccgacaccctgaccggcatgctgcggcggcacgagatcgccgtggtggagctgatcgatccgcccaagcatatggaagacgacaatccgggcgccctggtgccgccgccgcgctggatggatttccaggacgaggttttcccggtgctgcttcaggaatatgaattggaccgggtcagcctgtcgggccgcttttaccgcccgaagcggagtagctgaccccggtcagcaccagcccggcggcgggggcggtcggtccgcccttggtgcggtcgcgggcctccagcaccttggccatgtcgtcggggctccacttgccctcgcccaccagctttagggtgcctaccatgttgcgcacctgatggtgcaggaacgagcgggcctcggccacgatgcggatttcctcgccgacccgggtcacgtccagcacgtccagggtcttcatggggcttttcgcctggcattccgaggcgcggaaggtgctgaagtcgtggtggcccagcaggcgcctcgccccctcggccatggcctcggcatccagcgccaccggcacccaccaggcccggtgctggtccagtgccaggggtgcccgccggttgacgatgcggtagagataggcccgtcccaccgccgaaaaacgggcgtggaagtcctcgtccaccagctccgcggccaccaccgccaccggcttgggcttcatgtggtagttgagggcgtcgcgcaccgtgtcggcggggtagtcccggggcaggtccacatgggccacctggccggtggcgtgcaccccggcatcggtgcgcccggccgcatgcagggtgcaaggcacgccgcacagcttctcgacggccttttccagtatgccctggaccgacagacccttgtcctggcgctgccagccattgaagggggtgccgtcgtattcgacgagcaggcggtagcggggcattagcccagcaccgtgcccttggggatggcgtggccgcgcagcatctccgaggcggtcatgggggccttgccggcccgctgcaccttgagcggacgcagggcgaacttgccgcaggcgatggtgagctggtcgtcgagaaccgtgccgggggcgcctgaaccgggtgtcaccgccgcctcgaggaccttgatgcgctcgcccgccatctcgaaccacacgccgggccaggggttcagggcgcggaccttgcggtccagttccaccgcattccggcgccagtccagcagcccctcctccttggccagcttgtgggcgtaggtcacgccctccgccggctggggcgtggcggccgggggctcgtcatcctccagtctggccagggtctcgacgatcatgcgcgcccccatggcggccagcatgtcgtgcagccagggcgccgtggtgtccggggccagcaggatgctttcccgtgacagcatggcgccggtgtccagtccggcatccatctgcatgatggtgatgcctgtctcggcgtcgccggccaggatggcccgctggatgggggcggcaccccgccagcgcggcagcagcgaggcgtggacgttgaggcagcccaggcgcggcgcgtccagcaccgcctggggcaggatcaggccataggccgcgaccaccgccacatcggcctccagggcggcgaactcggcctgggcctccgccggcttcaggcttttgggcgtgcggaccggaatgccccgctcgtgggcgaaggcgtgaaccggggtcagctgttccttgtggccgcgcccggcggggcggggcggttgggagtagacgcagatcacctgatgcccggcctcgatcagcgagtcgaggatggggaccgagaagtccggcgtccccatgaacaccagcttcattccgattccttccgggccttgagcagcttgcgcaggatcatgttgcgcttcagcgaggacaggtggtcgatgaacaagatgccgtccaggtggtccatctcgtgctgcaccaccgtggccagcaatccgtcggcgaggatttcctgcttggcgccggtctcgtcgagatagcggaccttgaccgaagccggacgcaccacgttggaatagtgctcgggcaccgacaggcacccctcctcataggtgttgtcctcgtcggacgcccagacgatctcgggattgaccatgcggatgggggcgcgatcctcttccttgcggccgatatccatgacgatgacgcgctccagcacgccgatctggggcgcggccagcccgatgcccggcgcgtggtacatggtgtccagcatgtcggccagcagggtgcggatgcggtcgtccacggtggcgacgggcttggacttggatttcagcaccggatcgggcgcggtgaggatgggcagcacggccatgatggaactttcgatgaaatctctcccgtccgacataggccgggtcgggggcgaggtcaagcacgcttccccaggaagagcatgcggcgtaaaaggaagtcatgaccgacaccgattcccgcccccgtttccgcctgttcgtcgaagcccccctttcggccggaatggccgtggcgctgacccgcgaccagacccattacctcgcctcggtgatgcgggcggcggtgggcgagcttgtgctgctgttcaacggccgcgacggcgaatggctggcccgcatcgccgccctggccaaggccggcgccgccctggtccctgaatcccagacccgtccccaggcgcccgagcccgatctctggctgctggccgcgccgctgaagaaggaccgcaccgatctggtggtggaaaaggcggcggaactgggcgtctcgcgcctttggccggtgttcacccggcgcaccaatgccgggcgggtcaacgccgaccgcctgcatgcccatctggtcgaagcggccgagcaatgcgagcgtctgaccgtccccgatctggccgagcccgccgccctggacaaggtgctggccggctggcccgccgaaagggtgctgctgtttctggacgagggcgggggcggcgtgcccctggccgaggtgctgaacggcctgtccggccagaaactggccctgctggtcggtcccgaaggcggtttcgacggcgaggagcgccgtctgatcgcctccaggcccttcgcccgggccgtggggctggggccgcgcatcctcagggccgagacggcagccatcgccgccctggcggtggtgcaggcgctgaacggcgactggcagtccccgccccggacctagccttcgtctgtccgcgttgaagcggggcgtcagatattttgtgtatataaaataacacaaaagtagtttgcctgaatctggtcagggagggcggcgtcaaataatgggaaactgggtatgttaactctgtgtaaaagcctgatggtcaaaaagatcgttttgtgacgaacgcattgcattctgtctattatccgctcttcgaatggcggcatgcataattattggtacaaaagcctctgcctcatccttaagtttgcggtgtgctgaaaaattgggcgccagcaggctcccgagaatgccatcgccggaggcctggaatgccgagtgtcgccaccatcaggggcaagctgaccgcccttgccgttaccgttgccgtcgtgcttggcggactttcgctgggctggggcgtcgtgttgagcgagctgaaggtcaacgggccggtttatggccgcattgttcaggccaaggatctggtggccgatatcctgccgccgcccgaatacatcatcgaatcctatctggtcgcttcgcaggcgctagccgccgagccgtcgaagctggcgcctttgaaagaggccatgatccgcctgcgcagggattacgacgaccgtcatcaatattggcagggccaggatctggaggcctcggttcgggatgggctgctggtggagtcctacaagccggcggttcaattcttcgatcacgccttttccacctactttcccgccctggagaaaggtgaccgcgaggccgcccgtgcctcgttcgccgtcctgggcggcctttacgccactcaccgcgctgccatcgataccctcgtaacccgctcggacgccctgtccaaggcggtggaggcccaggccgcggccagcgaatccagctacaagctgctggtgatcgttctcacccttgcctcggctctggcggcgctggcgctggtgatcggcatgtcgcgggcgatcgtcgctcccatggcgcggctgggcgaggcggtggggcgtctgggtggcggcgcgctcgatgccggggtgccggagaccgaacgcgtcgacgagatcggccccctggcccgtgccctggacggctggcgccaggggttgatcgcggccgaggcccgccgccgggacgaggccgaggagcagtcccggcttcaggcccgccagcggcgggtcgaggcggccacccggcgcttcgacgaggcgatcatcaccatgctggcgcgaatccgggactccgccgagaacctgcacgccgcgtccaacagcctgtcggccaatgccgaacagacccatgcccagggtgccgccgtctcggccgccaccgagcaatcggcggccagcgtcgaaagcgtcgcttcggccggcaaccagctctcctcctccatcgaggagatctcctcccaggtccgccagtccagcgccatcgtggcggcggcgtcgcatgaagccgaggccgccaacggccgtatcgccggcctgaccgaggccgtcgaacgcatcggccaggtgctcagcctgatcaacgacatcgcgtcccagaccaatctgctggccttgaacgccaccatcgaatcggcccgggccggcgaggcgggcaagggattcgccgtggtcgcccatgaggtgaagaatctcgccggtcagacctcgcgggccaccgaggatatcgcgcggcagatcgccgccgtgcgcgacgaggccgggactgccgtggccgccctggccggcatcgcccaaaccatcgcccgcatcaacgagatgtcggcctccatcgccggcgccgtcgagcagcagggcgcggcggcttcggagatctcgcgcaatgtggaacaggccgccgccgggtcgcgtgaggtggtgcacaacatcaccggcgtggtgggggccgccggggaaaccggcgccatggcccgcaacgtgttcgccgccgccaaccagcttctggggcaaagcaccgagctggagcgcgaggtcgccgccttcctgcgggagatggccgcctgagcgggcctcgtgcggccgggttgaggtgaggcttggattccgggggcggctggtgccatgatgccgcccccaaatcccctgaggaatcgacgcccatgccgccccgcgccaatcccttgaagctcaatgcgctgcagttgaagaccctggtgctgttccaggaactggcccgccatcccgagacctccacccgcatggacagcggcgaggtgttcctgtcggccctgccccatccccacggcaaccacttccacgtgggccgcaaggtggtgatgagcaaggacgcctccggcctcgccaacggcgccgtctgggtggcgctggagcgcaagggcctgattcgcgccagcttccccatggcggtcaccctgacccccgccgggctggattacgagaccggtatcgccgacgaaatcctccacggctcggatcactgattcttgtccctcgccgggcgggtgctcgcgcacccttggccgccgcctcaatggcggctggaaaccggtgaaactaaaggattacaggtttcatgagctacaccgtccgcgaaatcttccactcgttgcagggtgagggcgtgcaggccggtcgtccggcggtgttcctgcgctttgccggctgcaatctgtggagcgggcgcgaggccgatcgcgagacggccacctgccgtttctgcgacaccgacttcgtcggcggcgagaaataccccgacgcccaggggctggccgaggcggtcaaggccgtgggcggggccacccgctacgtggtggtgaccggcggcgagccggggctgcaactggacggggcgctggtcgaggcgctgcacgggctgggtttcgaggtggccatcgagaccaacggcaccgtggaactgccgtccggtctcgactgggtctgcgtcagccccaaggccggcaccaccctcaaggtgacgcggggcgacgagctgaagctggtgtttccccaagccggtgccatgcccggggatttcgaacacctggacttcgcctatttcctgctccagcccatggacgggccggagcgcgacgcccatacaagggccgccatcggccattgcttgactcatccccgctggcggctcagcctgcagacccacaagatcgttggaataccctaatgtccaccttccgcgtccgccgccgtatcgagatcgatgccggtcaccgcatcatgacccacggctccaagtgccggaacctgcacggccaccgctatgtggtcgaggtggagtgcgaggcctcccgtctgcatcccagcggcgagcagaccgacatggtggtggatttcggcttcctcaaggacgagatgatgcggttgatcgacgcgccctgcgatcacggcttcatcgcctcggcggcggatggggaattgctggccctgttcgcgccccagggcgcggcgggatggaccgaatccatcctggccgaggtcaaggccaagggggcggcgctcaccaccagcacccgcatgggaaccaagctttacgtggtgcccttccagcccaccgccgaatgtctggccaagcactggttcgaggtgctggtcgccccggtgcgcacccgctcggattccaccgcccggctggtggcggtgcgggtgtgggagactcccaattgcatggcggaatacgcgccggcctgagccctttacattcataaatcaaggggaggtctggcataaatcaaggggaggtctggaggctcgcctccagccggggatacggggcgggagccccgcaagcgggagggggtcttgaacctcaagcagctggaatatttcgtgcgcgtcgccgagctgggcagcttcagcaaggcggccatggtgctcgacatcgcccagcccgccttgtcgcggcaggtgcggctgctggagaccgatctgcgcgccaatctgctgcaccgcaccgggcgcggcgtggcgctgaccgaggcgggccagcggctgttcgaccatgcggtcggcatcctgcaatcggtggagcgtgccaccgaggacctggaatcggcccgtggcgagccggcgggccgcatcgtcatcggcctgccgcccagcatcggccgccgtctcatcgtccccctggtggaagggttccgccagactctgccccgggcgcggctggccatcgtcgagggcctgtccacccatgtcaccgagtggatcgccaccgggcgggtggatctggggctggttcataatcccgagcccaatcccgccatcgaggtgtcgcgcctgctggacgagccgctggggttggtggggcccgccggtgacgttcccgccacgctccgttgggccgaactggggtcctatcccctgatcctgcccgagcgcggccacgccatgcgccgattgctggaggcccaggcggccttcgccgaggtgcgcctcaaggtggtgatggaggtctcgtccatcccctccatcctggatctggtggcggccggctacggccacgccgtgctgaccgagacggcgctggcctcgtggcgccgcgccgggggcttcagcctgcgccgtctggtggaaccgtccgtcgccagcaccctgttcatggcggtgtccgcccaaaagcccatcacccccctgggacgccgcgccatggcccttctccaggatttggtgaaaacagaaatgggctgaaaccattccagatataacaagttgctatagctgaaagtgccccgggggggcttggtggggcggcgcgaatttgtcaccatgacaaggtcgaatgctgggaggcccgacggatgcagaccccgattccttgcctgttcatgcgcggcggcacgtcgcgcgggccgttctttctcgagagcgacctgccggccgacatggcgctcagggacaaggtgctgctggcggtgatgggctcgccccatgcgcggcagatcgacgggctgggcggcggccatccgctgacctcaaaggtgggcatcgtgcgtcccagcaccacgccgggcgtggatctcgacttcctgttcgcccagttgcagcccgacagggagacggtggacaccacccccaattgcggcaacatgctggccgccgtggtgcccttcgccctggagcggggcatcgtcaggccccagggcgacaccaccacccttcgcgtgctgacgttgaataccgatatgcagtgcgacatcacggtgcgcacgccgggcggccggatggagtatcagggcgaggcccgcatcgacggagtgcccggcaccgcctcgcccatcgccatcaattttctcgataccgccggttcggtgtgtacgggcctgctgcccaccggccggacccgtgatgtgatcgatggtcttgaggtcacctgcatcgacaacggcatgcccatggtactgttccgcgccgccgacctgggccgcaccggtgccgagagcgtcgagactctgaacgccgacaccgaattgaaggcccgcatcgagaccctgcgtctcaaggccggacacctgatgggtctgggcgatgtcgggcccaagaattatcccaagatgtgtctggtggcgccgccttcggcggggggcgcgctgggaacccgctgcttcattccccatgtctgtcatgacgccatcggcgtgctggcggcggtgaccgtggccaccgcctgcgtgctggagggctcggtgaccgaagggttggcgaatgtgcccggcggcgcggtcaagaccatcgccgtcgagcatcccaccggcgagttcagcgtcgagctggagctggacttggctgacccgcaaaaagtcgttcgtgccgctcttctgcgcaccgcacgcctgttgatgaagggcgaggtgatgatccccgccgcgatctgggaaggaaagtccgcatgatcatcgatattcacggccattacaccaccgcgcccaaggcgctggaggagtggcgcaaccgccagatcgccggcctcaaggaccccgcccaggcgcccaaggtctcggagctgaagatcagcgacgacgagcttcgcgaaagcatcgagaccaaccagttggccaagatgaaggagcgaggctcggatctgaccatcttcagtccccgcgccagcttcatggcccaccatatcggcgacttccagacctcctccacctgggccgccatctgcaacgagctgtgcgcccgcgtcgccaagctgttccccgacaatttcatcggcgcggccatgctgccgcagagtccgggcgtggaccccaagacctgcatccccgagatcgagaagtgcgtgaaggagtatggcttcgtcgccatcaacctcaaccccgacccgtcgggcggccactggacctcgccgccgctgtcggaccgctcgtggtaccccatctacgaggccatggtggaatacggcctgccggccatggtccacgtgtcgacctcgtgcaatgcctgtttccacaccaccggcgcccattacctcaatgccgacaccactgccttcatgcagtgcctgacctcggacctgttcaaggactttcccgagctgaagttcatcatcccccatggcggcggtgcggtgccctatcactggggccgtttccgggggctggcccaggaactgaagaagccgctgctgcgggatcatctcctcaacaacatctttttcgatacctgcgtctaccaccagccgggcatcgacctgctgaccaaggtcattccggtggacaacatcctgttcgcctcggagatgatcggcgcggtcagaggcatcgaccccgagaccggccattattacgacgacaccaagcgctacatcgaggcgacgctgaacctttcccccgaagaccgtcacaaggtctacgagggcaacgcaaggcgggtctatccccgcctggacgcggcgctgaaggcgaaggggctctgatcatgtcgatgaacaatctgggcatcgtgaaacgcaacatcgtccgtgccgacaaggccgccgtggagaagctgtcgcgcttcggcgtggccaccatccacgaggccatgggccgcgtcgggctgatgaagccttatatgcgccccatctacaccggcgcccatctgtgcggcacggcggtgaccgtgctgctgcatcccggtgacaactggatgatgcacgtggcggccgagcagattcagccgggcgacgtggtgattgccgccgtcaccgccgactgcaccgacggtttcttcggcgatctgctggccacttcgtttagggcgcgcggcgccgtcggtctggtgatcgatgcgggcgtgcgagacgtcaaggacctcaccgccatgaatttcccggtgttctccaaggccatcagcgccaagggcaccatcaaggcgactctgggctcggtgaacattccggtggtttgtgccggggccgccgtcaatcccggcgacgtggtgatcgccgatgacgacggtgtcgtcgtggttcccgccccaatcgcccaggccgccgccgatgccgcccaggcgcgggaagacaacgaggcggccaagcgcgcccgcctggccgccggcgaactgggcctcgacatgtacaagatgcgcgaagccctggccgccgcgggactgaaatatgtcgactaggcccgcctcgccgctggcctggaccgtcggcctgatcggctacggcgaagtggggcgcatccttgccgaggacctgcgcgcccggggcgtggcggtgaccgcctatgacatcaagctgggcacgccggccgagcccgagctgcgcgaccacgccaaccgccacggggtgcggctggtggcggatcacgccgccctggtggcctccgccgatctggtgatctcggcggtgacggcgtcgcaggcggtgccggtggcccaggcggccgcaccgggcctgatgcccggcacctggttcctggatttcaactcggcctcgcccaaggccaaggtcgaggccgccgccctggtgagcgcggcccggggactcttcgtcgagggcgcggtgatgacctcggtgccgccctatcgcattaaggtgccgttgctgctgggcggccccgaggcaagcgggctgcagcccatcctgaatgatctgggcttcgccgccgaggtggcgtcggacgccctgggcgtggcctcggcgaccaagatgtgccgctccatcatgatcaagggcctggaggccatggtgatcgaaagcttcaccaccgcccgggcctatggcgtcgaggacgcggtgatcgcgtcgctggtggagacctttcccggcctggactgggaaaagctgggcacctacttcttccagcgggtgatccagcacggccgccgccgggccgaggaggtgcgtgaagtggccaggacggtgcgcgaagccggccttgatcccttctcggccacggccaccgccaatcggcaggcccagatggccgattaggccgatgacggcgtgttcggcgccagatccgacgccgctttcgccaaatcgggtgactggcggatcgaggccgaccgcattctcgcccaatccaaggaaaaggaccggtcatgaccttcgagaagacccccggctggctcgactggtatgccggtccctccaagcccgccttcgccccgccgccgggcgcggtggacgcccattgccatgtcttcggccccggcgacctgttccccttcgcgccggagcgcaagtacaccccttgcgatgcctccaaggaccagctgttcgcgctccgcgaccatctgggctttgcccgcaacgtggtggtccaggccacctgccacggtgccgacaaccgcgccatggtggacgcgctgaaggcgtcccaaggcaaggcacgcggcgtggccacggtgaggcgctcggtgaccgatgccgagctggccgagatgaacgcggccggggtgcgcggcgtgcgcttcaactttgttaagcgtctggtggacttcacccccaaggacgagttgatggagatcgcgtcgcgcatcgcgcccctgggctggcatgtggtgatctatttcgaggcggtcgacctgcccgagctgtgggatttcttcaccgccctgccaaccactgtggtggttgaccatatgggccgccccgacgtcgccaagccggtggacggtccggaattcggcctgttcctcaagttcatgcgccagcacgggaatgtctggagcaaggtcagctgccccgagcgcctgtcgctgaccggcccccgcgccctggacggcgaacgcgccgcctaccgcgacgtggtgcctttcgcccgggcggtggtcgacgagtttcccgaccgcgtgctgtggggcaccgactggccccatcccaatctgaaggaccacatgcccgacgacggcctgctggtggacttcatcccccatatcgcccccaccgccgatctgcagcgccggctgctggtggacaatcccatgcggctttactggccggaagaaaggacctgatcgtcatgagcaagcccgtcaacatcgccctgatcggtgccggcgccttcggcgtcaagcatctggacgcgctctcggtcatcgacggcgcccaggtggtttcgctggtcagcaggcctgaggacaagccggaagagatcgccgccaaatacggcattccccatgtggcccatgatctggccgagtccctggcccttccccatgtggacgcggtgatcctgaccacgcccacccagctccacgcctcccaggccatggcctgcctcaaggcgggcaagcatgtgatggtcgagattcccatggccgacaatctggccgatgccgaggccctggtcgccctacagaagaagaccggtctggtggccatgtgcggccatacccggcgcttcaaccccagccaccaatgggtccacaacaagatcaccggcggcgggttcaacatccagcagatggatgtgcagacctatttcttccgccgcaccaacatcaacgccctggggcagccgcgctgctggaccgaccatctgctgtggcaccacgccgcccacaccgtggacctgttcgcctaccagaccgggggcgagatcgtcgccgccaacgtccttcagggccccattcatccggacctgggcatcgccatggacatgtccatccagttgaagtccagcaccggggccatctgcaccctgtcgctgtccttcaacaacgaggggccgctgggcacgttcttccgctacatcggcgacagcggcacctatatcgcccgctacgacgacctgttcgacggcaaggaccagcccatcgacgtcaccaaggtggacgtctccatgaacggcatcgagctgcaggaccgcgaattcctggccgccatccgcgaggggcgcgagcccaacgccagcgtggccaaggtgttgccgtgctaccgcacgctccacgccctcgaacagcagctgaagcaggccctgtgatggaacggcgccgcatcggtccctttagcgcgtcggccttgacgctgggctgcatgaatctcagccatgcctacggcacgccgcccgaccgggggacggccgaggcgctgctgcggcgtgctctggactccggcgtggatttcttcgacaccgcggcgctgtacggcttcggctccaacgaaaccctggtgggcgaggtgcttcggccccatcgcaagcgcatcaccctggccagcaagtgcggcatgaccggggtggacggcaagaaggtcatcgacggacgcccagagaccatcctgcgcacctgcgacgacagcctgaagcgcctggggaccgaggtcatcgacctctattacctgcatcgccgggatcgtcaggttcccatcgaggaaagcgtcggcgccctggcccggctggtggagcagggcaagatccgcgcggtcggcctgtccgaggtctcggccgagaccatccgccgcgcccatgccgagcacccgatcacggcggtgcaaagcgagtattccctgtggacccgcaatccggaaatcgcggtgctggagacctgccgcgagttgggcgccgccttcgtggccttcagcccgctggcgcgcagtttcctgaccggcaaactgaccgatccctccacccagttggaggacaaggatatccgccgccagatgccgcgcttcgaggccgaggcctatgccggcaatctcaagctgctggatggccacaaggccatggccgccgagacgggctgcacgccggcccaactggccctggcctgggtcctggcgcgaggcgacaacgtcttcgccctgttcggcaccaaatccatcgcccacctggacgagaacctgggcgccgatggcctcaagcttccgccggagacgatctcccggctggatcagctcatcaatcagaacaccgtggtgggggctcgctacagcgcggccatccagaccgagatcgacacggaagaattctagacaggaggatacacgtggcacccaaaaccaagcgggtcatacccggaaccaccctgttcgacggcgacatggcccgcaagggctatgcgttgaacaagatgtgcttctcgttcaactcggaagaaaaccgtcaggagttcctgaaggacccgggcgcctattgcgacaagttcggcctgaacgagcagcagaagaaggcggtgatcagcctccaggtgctcgacatgctggcggcgggcggcaatgcctatttcatcgccaagctgggcggcatctacaagcttgatatgcaggacgtcggcgcgcagcagaccggcgtcaccaaggaagagttccaggcgaagctggtcgccgcggggagggaatagtcatggccaagatcgtcggtggcatcaacgtcacccatgtgccctatatcggacgcgccatcgcgggcaacctgcagcaggatgcctactggaagcccttcttcgacggctttccgccggtccatgcctggctggacaaggtcaagccggacgtggccgtggtggtctacaacgaccacgggctgaacttcttcctcgacaagatgcccaccttctccatcggcgcggcggccgaatacagcaatgccgacgagggttggggcattcccaccgtggcgccgttcaagggtgaccaggacctgtcctggcacctgatcgattcgctgatcgaggccgaattcgacctgaccacctgtcaggaaatgctggtggaccacgccttcaccctgccgctggagctgttgtggcccacgcgcaacgccgctttgcgcaccgtgcccatctgccagaacaccgtgcagttccccctgccctcggccaagcgctgccttgccttcggccgcgccatcaacaaggccatcgagtcctgggacagcgacgcccgcgtggtggtgctgggcaccggcggcctgtcgcaccagctggaagggactcgggccggcttcatcaacaagaagttcgacctggagttcatggacaagctggtcagcgatcccgactgggtgacccagtattccaacgaggatctggtcgagctgaccggcacccagggcatcgagctgctgaactggctgacctgccgcggcgcgctgggcggcaaggtcaaggcggttcacaccaactaccatatccccatctccaacaccgccgccggcctgctggccatggaaacggtgtaggcatgggacagggtctgggagagcggaaatgagagttcaagtcgccatcatcggcgccggtccgtccggcctcatcctcggccagttgctggccaaggccggcatcgacgccctcattctcgaggcccagacccccgactacgtgttgggccgcatccgggccggggtgctggaacaggtttgcgtcgacctgctggacgaggccggggtgggggagcgcctgcatgccgaggggctgccccaccagggcatcgaactgctggtggacggcacccgccaccgcatcgatctggcgggcctgaccggcggcaagcaggtgacggtctacggccagaccgagttgacccgcgacctgatggaggcccggacccgggccgccctcaagacggtctacgaggccaaggaggtgatggtctcggatttcgacaccgatcatccccgcgtcagctatctcaaggacggcgtgcgccacgaggtcgaatgcgacttcatcgccggctgcgacggctatcacggggtgtgccgggcctcggtgcccaaggatgcgctgcgcaccttcgagcgggtctatcccttcggctggctgggtctgctgtccgacaccccgccggtcaatcacgagctgatctatgccaagagcgaacgcggcttcgcgctgtgttcgcagcgctccttgacgcgctcgcgctattacctccaggtcccgttgagcgagaaggtggaggactggtccgacgagcggttctggggcgagttgcgccagcgcctcgacggccgggccaacgatgccctggtcaccggcccatccctggaaaagagcatcgcgccgcttcgaagcttcgtagccgagcccatgcgcttcggccgcctgttcctggccggcgacgccgcccatatcgtcccgcccaccggggccaaaggcctcaatctggcggcgtccgacgtgcgcactctcggtcatgccctgatcgaattctatggcggcagcctcgaaggcatcgaccgctattccgagcggtgcctgcgccggatctggaaggccgagcgcttctcgtggtggatgaccaatctgctgcaccgctttcccgacacgccgcccttcgagcagcgggcgttggaggccgagctggactatgtggtccattccctggccgggcggaccaccatcgccgagaactatgtggggctgcccttcgaggactgagccccttttcccataagcagtgaactcaagggcccgaaagaggcccgatgccacacccatgcccggttccgggcgtgaccggatgacgattgccttgtaaaaggatggagcccaagagatgacacgggacaaccagttgaatattcagacatttttgaatgaaagccgattctcgccttatcagtggacggtgtttgccctgtgtttcttcgtggtgttgctcgacggcttcgacacggcggccatcggctatatcgcgccgtcgctgctcaaggaatggggcatcgccaagcccgccctggggccggtgctgtccgccgccctgttcggtctggccgccggcgccctgtcggcggggccgctggccgaccgcttcggccgccgcctggtgctgaccggctcgaccctgttgttcgctctggccagtctggcgtcatccttcgccggcagcctggacgggctgaccgtcctgcgcttcgtcaccggcatcggcctgggcgccgccatgcccaacgccgtgaccctgatcagcgaatattgccccgaccagcggcgctcgctgttgaccaacgccatgttcgccggctttcccctgggggcagccctgggcggctttctcgccgcctggatcatcccgcaatggggctggcgctcggtgctggtgctgggcggcatcgcgcccctggccctggtggccctgatggccgtctccttgccggaatccatccgctacatggtggcccgccgccagccggccgagcgcatccgcaaggtgttgagccgcatttccgcctccgccgcccaggcccagggcttcgtcatgaccgaggcggccgccaaggtggcgcccaccggcaaggccgggctgggcgtggtgctgtccaagagctatctcgtgggctcggtgatgatgtggctggcctatttcatggggctggtgatcttttacggcctgatcaactggatgcctctgctgctgaaggacgcggggcttgaccccaagagcgccaccctgatttccgccctgttccccttgggcggcgtcggcgccatcttcttcggctggctgatggaccgcgccaacggcaacaaggtcatcgccgccggctatgtgctgaccgctttgctgatcttcgccatcggtcaggcggtgggcaatgtgggcgtcctggttctgctggtactggtggccggcaccttgatgaacaccgcccagtcctccatgcccgccctggctgccggtttctaccccacgtcggggcgcgccactggcgtggcctggatgctgggcatggggcgcttcggcggcatcgccggctcgaccctggtggccgagctttcgcggcgtcagctggggttctccgagatgttcaccatcatcgccattcccggcctgatcgccgccgccgccctgctggtcaagcagatggcccatcccgaaacccccgccgagcacgacgcggcggtgggcgaagcccatgagcatgcccaggaagcccagctgggcgggcattgaggacgcaatcccggcggccggaaacggctgccggggctactccgccagtttcctgtcgcgctcgaaccgcacccgcacttcgatgccgcgccgggtcagcagggaatgcagcgccagggtgaccatggtgcccagccaggcccccgccaccacgtccgacaggaagtgcacggtggtcagcacccgcgaaagcgccaccagcagagccacggtgatgaaggcgatgtcgtagcggggaaagatcagggccagggcggtcatggcggtgaacgacgcctgggaatggcccgacgggaaggaattggtgagataggcccgggtcaggggcacgaagtcgtagacgttgctgtcgaacagggcggcgggtcgggtgcggcccaccagcatcttgatgatgttgccggcgatgccggaaacggccatggacaggaacaggaagcccggcacccaggcggcccggcgcaggcgggcgcgcttctccagtcccggcgcggccagggcggagaggatcagccccagcgtcagtatgccggcggggatcatccacacgccgcccagccccagatgggtgacggtcttccagaagccctcgaactcgccgctcacatgggccttgaaccagcgggccagggggcggtcgaggatgaaatagccgatcagcaccaccagggcgcagtaaagcgtcgaccagatgcggggatggcggcaggtgcgcgcccattgccccgcgctgaacgagcgaaagccggccagctcctcccagaccagggtgatgtggttgccgcctctttcccactggcggacgatgacatccagcagcctcatggcgccttgccctccaccgcataggcggtcagcgtcaccttgcgcccacgggaatagttgaagcccttgaccacgcccaccaccaccggcttgaccccgatttgggcggcggcggcgaagaatttctcctcctcgcggtccgacaccagggtcagggcggcggggccgttggtcaggtgctgggcggcggcctcgccgctggtcagcaccgtatcggtgcccagcaggaagaccaggctgggctcggcatagccggccaccaccaccgcgccgcgatgaggacggttggccaccagctcggcggcctgccggctgacgaacagatagtccaggccgggcagcacgccctcgaacaccacctggaagctggtcaccgccgtcagcaccagggccatgaccgccgggcgcatctgctccttgaaggccagccaggcggcggccagggcggtgccggcgatcagcagggccgagggaatgctcatcagcggcagggtcggggcgaactgatggggcaggatcaccaccgccgcggccagggcgaggccgatcacgcaccacagcccgtaccaggccttggcgggccgcgaccacaggtcgggggcacgccccaccaccgccaccgccatcagcagcgccagggcgggaaaggtgggcagcacgtaatggggcagcttggtgggcacgatctcgaacatcacccaggcggggatgatccaggcgaggcagaagcggatctcggggcgcagccgcaccttccaggcggcggtcagcgagggccacagcagcagcgagccgggccacaggatcaccgccgccagggcgagataggtgccgggaaggccgccatggctttcctgggcgcccagcagcttgggcagcaggtcgcccttgaccgcctcgcccacgaaggcgccgccggtggcctgggaaatggccacgaaccagggcgcggcgatggacgccgccacgatcagcccggtgaagggccgcaatcccaccagccaggcccattgccggtcggcgaagcccagggccaggatagtcaggatggtgatggccgggatcaccggccccttgagcaggatcgaggcgccgatggccacccagaagaccagggcgatcaacggccccggaacggccccctggcccttgcccccgagatagaagcgggccagtgcgccttgcgccgccacggcggtggccagcatgatggcgtcggtcttggcctgatgggcctcggagaccagcatcagcgaggtgccgagcaaggccgcgccgatcagcgccgtctggcggccgaacaggtattggccgaaagcgaaggtcatcagcaccgccccccaggccgccagggccgagggcaggcggtagggccacacgtcacgcgtggccttgtcggacagcaggctgaccgaggcggcctgaagccaataggcgcccaccggtttcttggcgcgcatctcctgctggaactggatgcggatatagtcgccggtctccagcatctggcgggtagcctggacgaagcgcgattcgtcgcggtccatgggcggcagggccaccagacccggcagatagacgaacagcgacagcagcgacagcaggagataggggcggataccgccggtcagtcgttccacgatggggcgatccgtgcagattcgagaccggcatcaacagcatgaagcagcccgcccggtcaaggggtgctgcggcgcgcggcccgtctcgccaatccaggcgcgccgaattcggcgggctggcatgcgtcggcaggggggtgtcggttcaattcagatgctgcggcgcaaaatccggcgatctagtctccaaggcgtttcgtggcacggcagaatgcgggcgccttccaccggaaccagatgccgccgaagcggcgtccgggccgggatatgcagagcaagggaccgattgatgcttggaaacctgaggattgccgcccgcctgatggtggggttcggagtgcttgtcctgctgatcgccgggctgtccggctatggcgtctattcgggcagcaacaccggcaaggcctttgcccgcgccgtgcggctggtgagcaaccaggccatggtggaaaagcttgagaaggaaatcttccaggggcgcatgctggtctgggtcgccctggccaccggcgaggacgccaagatgggcgcggcccgcgccagcttcgattccgcacgcggtaatctggacaggttgcgcgccgcgaccgtcacgcccgagcgcctcgcccggatcgatgaactgagccggctgctcggcgactatgatcgggagatcgccaagatcaaggtgtccagcggccgggccgcgtccctcgacaacgcggaaacagccgccgccgctcccgccgccgccgccatcgccaccaagctcgacctcgtgggagaggatctggcggcaaacttccaccaggtcgcccttgaggttcaggcgggcgccgagcggcagatcgacgaagccatcgacgcctcgcttcttgtcggctcgctcagcgtgatcctggggctggtcctgtccttcttcatcggccgctccatcagcgcgccggtgatcgccatgaccaatgccatggaggccctggctgcgggcgacaccaccatccatgttccggcgacgggcaaccgcgacgagatcggcgacatggccaaggcggtccaggtcttcaaggacaacgccatccgcgttgccgcccttcagacggagcaggccgaggccaaggccagggccgaagccgatcgccgccgggccatgctgggcatggccgattccttcgaggcccaggtcatggggctggtcaagggtgtctcggtccaggccacacagatggaggccgtttcccagggcgtttcctcggcggcccatcaggcccaggcgcaggccggcaccatcgccgccgccgccgggcaggccaccggcaatgtgcaggccgtggcggcggcggccgaggaattgtcgtcctccatctccgagatcggccggcaggtggccgatgccgcctccatctcgcggcaggcggccgaggaaaccgagcgcaccaacgacatggttcgggccttggccgaggccgccgggcgcatcgatcaggtggtcagcctgattaccgacatcgcgtcgcagaccaacctgctggcactcaacgccaccatcgaggccgcccgggccggcgaagccggcaagggcttcgccgtggtggcgggcgaggtcaagaatctcgccaaccagaccgccagggccaccgaggagatcggcacccagatcggcgcggtgcaggaggaaacccggcgcgccgtggaggccatccgcaatatcggcacggtgatcggtcaggtgcgtgaaatctcggggggtattgccgatgcggtggaggagcaaagcgccgccaccgcggagatcgcccgcaatgtccagcaggccgtccagggaacccaggatgtctccctcaacatcgccggggtgtccgaggcggccagctccaccggggcggcgtcgcggcagatgctggccggggcgggggaactggcgggcaattccgcccggctgcgcgacgaggtggtccgcttcctcgatcgcgtccgggccggatgagttaccgggccgcggcggaatcctcgtccaaggattccttgaactcggacgaggccttgagacggtccatgtagcggatgtcgcggcggctggtcagggggaacgaggcggcgttaaagctgccgcgcgcaccgcagccatagttgccgcagcggccgttttcgtcgcccagggtcagctcgccatccttgacccgcaggctgagttcgcagccgtcgcccgatcgccccttggaccgatggaccagggtctctcccgagatatgggcgatgccccagaaattgcaggaatgcccattgctgaacgccagggcgaggcggagataggcccggtcgggggcgatcttgacgatctccatgatgtcttcgctgacgtacttttcgccgtcggccatcgcgttctggaaccggtgcttgtagaccccggccagggaatcgagatcgagagcccgcgccgtcacgggcagggcaagcagcaatgcggcgacgacggcaaccaatcccctcatgatccgttctcccgacccggaatgcgaggggagcactctaggtcactccgccgccgcttgccagaccccggtttcaaacggccgtagattgtccaggaattgccgggtgcaggcctcccacgagaaggtcagggcatgggcacggcacagggccggatcgatggacagggcggcgcgggccgccttgcccaggtcctggtccagcacgccggagggcgaatcgccgatcacgtcgttggggccgggcaccggataggcggccaccggcaggcccgaggccagggcttccagcagcaccagcccgaaggtgtcggtgcgggacggaaagacgaacacgtcggcggcggcgtagtgccgggccagatcctcgccgaagcgggcgccggcgaagtggacctcggggaagcggcgcttcatctcgtccagttgggggccatcgcccaccaccgccttggctccgggcaggtcgagggccaggaaggcctcgatgttcttttccaccgccacccggccgacgtaaagaaagaccggccggctcaaatgggcgaaggggccgttttcgcccctgacctcgggacgggggcggaacagctcggtatccacgccgcgggaccagcggccgatattgcgaaagccccggcccgtcagctcgctctcgatgccctgggtcgccaccatcacccgcgacgacgaatcgtggaagcggcgcatcagcgcataggtcagcggcagcggcacgccgaagcgggccttgatgtattccgggaacttggtgtggtaggcggtggtgaagggaatcttccgccgccggcaataccgtctggccgcccagcccagagggccttcggtggccacgtggatggcgcagggctgggccgcctcgatcatggcggccagcttggcgccgggcctcagcgccaggcggatctcgggataggtggggcagggaagggagcggaagcggtcgggcgtgaccatcaccacctgatggccggtgcgttccagctcggtcctcagggtatcgagggtgcggacgacgccgttgacttgagggagccaggcatccgtgacgacgagtattcgcatgtgtttccctcgacctccagccagcggatgatttccaaggcgccgtcgaagccctccaccagggcggtgcagctttcgacccagtcgccgtcgttgcagtagaggatgccgttcacctcgcgcttctcggcgtggtggatgtggccgcacaccaccccgtcggccccgtggcggcgcgcttcgtcggccatggcctcctcgaagctggccatgtactgcacggcgttcttgaccttgtgcttcagataggccgacagcgaccagtagggaaagcccatggcccggcgcaccacgttgagccagtggttgagcgacagggccagggtgtaggcgctgtcgcccagatgggccagccacttggcgtatttcaccaccccgtcgaaggcgtcgccgtgcaggaccagcaattgccgtccgtcggcggtcttgtgcacgacggtggtcaacacctcgatgtcgccgaacagcaggccgtgatagtcgcgggcgaattcgtcgtgattgccgggcacgaacaccaccctcgtacccttgcgcgccttgcgcagcaacttttgcaccacgtcgttgtgactttgcggccagtaccacgagcgtcggagccgccatccgtcgacgatgtcgcccaccagatagagggtctcgcactcggtgtctttgaggaaatccagcaggtcgtcggccttgcagccgcgagtgcctaagtgaatatcggaaatccagatggtcctgtaacgcctcttgatgtcgagactggcgttcatcgggcaatcatccgaagtattgttgatccgtattgatggagtacatagcttatgtggcttcggcattcatgctcattatcgtgaataacgtgatatttcattgaagtgaagcttatcggtcataaataattcaccatactctctggtgcttcaggctatacacagcccccatgacagtcgatcacgccgcctgcctgacctccaccgagccgttggccgccatggcgccgcggcgaatcctggtgattcacaaccccaccgccggccgtcgccgtcgccgccacctggaatctgtggtggccgccgcccaggccttgggagcgacggtgacctgccgcgagaccggacggcgtggcgatgccgaggactttgccgctctggccagcgccgacgatttcgacgcggtgatcgcggcgggcggcgatggcacggtcaacgaggttctcaacggcttgggggcggggcaaggcggtctggccctgggcgtgattccgctgggtaccgccaatgtgctggcctgcgagatcggtctcgatcccgacgacgtggactcggtggcccgcacggtcaccttcggccccgcccggcgcatccatgtgggcttggccaaccggcggcgttttttgctgatggcgggcgccggcctcgacgcccatgtggtggcgggggtgagcaccgcgctcaagcgccgcgccggcaagctggcctatgtggtggaaagcctgcgtcaggcggtgggctatgattttcccaagctgaccgtccgtgccgatggcgtggagtacgaggcccgcatggtggtggcttgcaaggggcgcttctacggcggtcccttcatcgccgcccccgatgccgatctggcgacgcccatgctggaattgtgcatcctgcccaataccggcgtggcgggaatgctgcgctacggcatcgccctgccgctgggcaaactgccggccctgcccgaggtgcaggtggtgtcggcccgcaacatcctgatcactggaccgcgcggcgccccggtccagggcgacggcgacatcgtcgcccgcctgccggccgagatatccatcgccgacgagacggtggacctgatctgtccctgaggttcaggccttaatcttccaggtcgtcgtgctccatggcgcggcggcgctcttctgcctgggaatgctggctggcgaattcaccggccatgtcgagaatcaggatggctccggccagccgcccccaggcgctggtttgctcggggctgcgcggccgcagcctggcccgcaggtccaccagcaaccgcatcaacgtccgtcccggcatcagaccgaggggcacgtcgggcagggcggcgatgccgaacgcctcctgcaccgcttccagtcccgcgcggatgtaatcctggtcgccctggtccagcggcaagatgcagtccggagtcttgcggaccagccgttcgccggcgaggtcggtggggggagggggcgtcatgctcggcatcttcggtgttcgggggtgatacggagtgttcttcttccaatatatggtgggcgccgcaacgaagaaagacggggcgacggggaaagatcaggtatgaacgaggttttggacgggatcgccgggtaccatgtccgcaccaagcatgcgaaccggcgttacgcgcctgggccgggcttcctggattgggagacccagcccgatcccttccggaccttcgcgggtgcccggcgggttgcccttcctctgcgtcctggggccgaaactccacccctcggcggattggaggcgcggcggccctcgccgctggattccgacgggctggggctgttcctggaactggcgctggggctgtcggcctggaaggaggtggaagacgttcgttgggcgctgcgcaacaatcccagcagcggcaaccttcaccccaccgaaggctggctggtcctgccgccggtggacggcatcggcgtggcgccgggcctttatcactacgccccgttccatcatgccctggaagagcgatgtcgcctggatgcgcttcccgccgatctggcggagggcgccttcctgctggccttgtcctccattccctggcgggaatcgtggaagtacggcgagcgcgccttccgctactgccagcacgatgtcggccacgccctggccgccgcgtcctacgccgccgcctgcctgggctggcatctgcgggtcctgaccgcgccgggggacgaggaactggccgccctgctgggccttgaccgtccggaatcctgtcatcgcttcgagcccgagcatcccgacctgatcgccctggtgtcgcccgagcccctgcccgagcctcccctgaggccggtcggcggagtctgggcgggccaggccaatgtccttagccccgaccacgaggtgtgggaggcgatcggccgggcgctggccctgtcggagaaaccggccaccgaacccgccccccggccgccgtccctgtccatgccgccgctgcccggcagtgccgagcccgccggggccgtcatccggcggcggcgcagcgcccaggccatggacggggcgaccggcatggggctggaagctttccggcgggtcctcgccgccaccctgcccgaccacgggcgggtgccgtggcggtcctggccgtgggcggcgcggctctccctgctgctgttcgtccatcgggtggacggcctggcccccggtcttttcctgctggtccgcgacccggccgccctggagcggttgcgggccgattgccagccccgtttcgcctggacaagggcgatgcctgacctgccgctctatgctttggccgagggtgacgtcacctggacagccaccgaactgtcgtgcacccagaatatcgccgggcggggcgccttttcgctgggcatgctggccgatttcgaccgcaccttggccgaggacggggcctgggcctatcgccgcctgttctgggaagccgggatgatcggtcaggttctctatctcgaagccaccgccgccggcctgtcgggtaccggcatcggctgctatcacgacgacgaggtccatgatctgctgggcttggcccccggaagccaagcctggcagtcgctctatcacttcaccatcggcggcgcggtggaggacgcccgcatcgccacgcggccggcttatgggcacctcaatccggctggttctccaccctgacccagtcgccgccgcccaactgggcgcgcatgcgggcggcctcctcacaatcggtgacgaaggccaggatggcgcttcgcgcgcattccgccgggtcccggcccaactggcgggcggcggtatacaggcgcgacgccagaacgggatcaaggtcgatgcgcattgcggaacactcccttgtttgcccctcagacgccgggcgcgtccgttccggacgcttggctttcctcgcttatgccttcgcttcgctttcggcaacgctgcggcgcgctcaacgcgcatagtcgctacgctccggagctaatcctcttgattcttgcaccgcttagggcgaaaacccagccctatgagcactctctccgacgctatcgcgctgcggcgcaccttcgccatcatctcccaccccgacgccggcaagaccacgctgacggagaagctgctgatgttcggcggcgccattcagatggccggcgccgtgcgcgccaggggcgagcagcgccgcacccgctcggactggatggccatcgagaaggagcgcggcatttcggtgtcggcctcggtgatgagcttcgaatattcgggcctgtccttcaacctgctggacacccccggccacgaggacttttccgaggacacctaccgcaccctgaccgccgtggactcggccgtcatggtgctggacgccgccaagggcatcgagacccagaccctgaagctgttcgaggtctgccgcctgcgcgacgtgcccatcatcaccttcgtcaacaaggtcgaccgcgagggccgcgagaccttcgacctgctgcacgaggtggaaaagaccctggcgctggacgtctgtcccgtcacctggcccatcggcatgggccgtgacttgaagggcgtctacgacctggtcaacgaccgggtgatcatgttcgaccccggccgcggcgaccatatcgccgagatcagcgtcgatgcctcgctggacagccccaagctggacgaggtgctgggcaaggccgccgccgaccgcctgcgcgaagaagtggaactggtgcgcggcggctatcccgaattcgacctggagtctttccgcgccggtcacctgaccccggtgttcttcggttcggccttgaagaccttcggcgtggcggaactgctgaagggtatcggccagctggcgccgccgccggtggcgcggcccaccgacaagcgggtggtggagcccgacgaggccaaggtcagcggcttcgtgttcaaggtccaggccaacatggaccccaaccaccgcgaccgtatcgccttcttccgcatctgttcgggccgcttcaagcgcggcatgaaggtcaagcacgtgcgctcgggcaaggtgatggccctggtcaacccggtgttcttcctggcccgcgaccgggaactggcggaagaagccttccccggcgacatcatgggcattcccaaccacggccagctgcgcatcggcgacacgctgagcgagtccgaggacatgaacttcctcggcattcccaccttcgcgccggaagtgctgcgccgggtgcgcctcgatgatcccatgaaggccaagcagttgaagaaggctttggaggatctggccgaggagggcgtctcccaggtgttcaagcccctggacggctccacctggatcgtcggcgtggtcggtccgctgcagttcgacgtgctgaccacccgcatcgaatccgaatacaacatcaaggccgggttcgaggatggcggcttcgtcaccgcccgctgggtggcggccgacaccgaggccgagatgaagcgcttcatggacggcaacaagtccaacatggccgaggaccgtgacggcggcatggtctatctggcgcgcaattcctggcagctcaaccgcgcccagcaggatttcgagaagatccgctttaccgccacgcgcgagcagcattgagccgcgagggcatgatgcggtcctgccgcatcatgccctgatcgggtggctcagcgctcgcgacgctcctcgcgatgctcgcgccggtccttgtcgtgctcgcggcgatcctcgcgcatctcccggcgatcgtgctgccgctccttgcggtcgtccttcagttccttgcggtccttgcgcaattcggcgcgatccttggccacggcgtccttgtcgccgtccttcctgtccttgcgcaactggttgcggtcctggacctcttcccgccggtcctggccgatctcgcggttgtcgcggcgcatttcctggtggtcccggcgcatctcgccctgctgggcggcggccggcaggctggtcagcagggggatcgcggccagcagggcaaacaggggcttgttcatttcaggtggcactccgaagggtggacgtgacgccatcaagccatggctttgcggcgaaaaaatggacgtcacggggcggcgggaatgtccacggtgaagcgtgccccgccctcatcgcggttctcggcgcggatggcgccgccatgggcctcgacgatctggcgcgagatggacaggcccaggccggaatgggtgccgaacttctcgccctcgggccgctcggaataaaagcgctcgaagatggcgtccagcttgttggccggaatgcccggcccctggtcctcgaccaccagggcgatgcgtccgccgtcgcggtgggcggcaaggcggatcagtccgccgtccgggctgaacgaggcagcattggcgatcaggttgcgcagcacctgcaccagacgggactcgatgccctgaaccgtcagggcgtcgccctcgggccgctccacctcgaagcgcagcccccgatcctcgcaggtgccgcgatagatctcggccagggtgtcgagcatggcggccagggccaccggcccggtctcggcacggctcatctcggcgtcgatgtgcgacgcgtccgagatgtcgctgatcaggcggtccaggcgccccacgtcgtccaggacgatggacatcagccgggcgcgcttgtccgggtcttcgatgcgggccgccgtctccaccgccgagcgcaacgaggtcagcggattcttgatctcgtgggccacgtcggcggcgaaggcctcgatggcatccatgcgccgccacagggcctcggtcatctccttcaaggccaccgataactcgccgatctcgtccttgcggtgggacaggtcggggatggcgtgaacccgcccttggccatggcgcacccgctcggcggccagggccagacggcggatggggcgggcgatggtgccggccatgtagagcgacacgccgatggtcagggccagcgaaacggcgaaggcctgcaagatggcgatgcgcacctggaacagcgagcgggcgatattggtgccgtcggcggtgatcagcaacgcgcccactacctgcttgtaacgctggaccggcaccgccaccgacagcatcagggtgccgttcttgcgggtgcgcaccgcccaggcggcgcgcccggccatggcgctcatggcttcctcgaaatcgtcggcccgcgcattggcgatgtcgcggtaaagcggcagggactcgtcccggggcatccagcgcgcccagcggtcccactgccgcgccagacggtcggtccaatggcggggagtgggcgggggcagttcctcgatatagatggagcctttggcgccgcccaccacgcgggaatcggcggccagttcgcccaccgccccgaacaggcgggcgcggaacttggcgggctcggacaggcgacgcaccatctgctgcgccatggcgggattgatttcgaagaagcccatttcctcttcgaacaccgcaccctcgccgatggcgccggccaccatctcggcctgggtgcccagcccgtccagctcggcgcggatcagcccctgcttgtagcggtcgagatacatcacgcccaccaccagcacgatgggcgccagcaggttgaccgccaggatgcgccgggtcagcggcgaggcgagcaggcgccagcggggcaggcgccgccggggggcggtggcctcactcgtcacgatagcgataaccgacgccgtacagggtttcgatctgggcgaagtcgtcgtccacctcgcggaacttcttgcgcagccgcttgatgtggctgtcgatggtgcggtcgtccacatagatggactcgccataggccgcatcgatcaactggtcgcggttcttgacgtggccgggacgcatggccagcgacttcagcagcaggaactcggtgacggtaaggtcgacgggcttgcccttccaggtgcagatatggcggccggggtcgagcaccagcaggccgcgcaccagggtctcgcctccctgctcggcgccttcggcattggcttccaggcggcggatcagggtgcggatgcgctcgatcagcagcttctgcgagaaaggtttcttgatgtagtcgtcggcacccatgcgcaggcccagcaactcgtcgatctcgtcatccttggaggtgaggaagatcaccgggatggccgattgcttgcgcaggcgctgcagcagctccatgccgtccatgcgcggcatcttgatgtcgagcacggccaggtcggccggctggctggtcaggccgcgcagggcctcggccccgtcggtgtaggtgcggaccttgaagccctcggcctccagcgccatcgagaccgaggtcaggatgttgcggtcgtcatcgaccagggcgatggtatgggacacggctgaacccctttgcaattgacctgtcatcccgagcggatgcaagggatctccgtttgctcggacgggccggagcaggaggagatccctcgtcgctatgctcctcgggatgacatctgaagacaagccccgggaatggtttgcatcccgatcatggcgaaattatagtgcccggcgatggttccccgcgaccggcgacggcgcggggtgaaaatgggaacgcggtgaggcacccgaaaagggggccgattccgcgactgcccccgcaactgtaggcggagaggttccggccctgagagatgccactggcccgaaaagggctgggaaggctatgccggacccaacgacccgcgagtcaggagacctgccatcatcgagagtcgcttgcgagcccgtccggccggggtgtgccgtcgggtctgttttccgtttcgcggcgactggcttagtctctcgacgaacggagtccgtttatcatgcatatcatggaaggttttcttcccgccgggcatgccctggcctggacctgcgtcgccgcgcccttcgtggcgctgggggcgcgctcgctcaagcggatcgtggccgaacggcccgaggcgcgtctcaatatcgcggcatccgccggcttcaccttcgtgctgtccgccctgaagctgcccagcgtcaccggctcgtgctcgcatcccaccggcacggcgctgggcgccatgcagttcggtcccggcatcatggcggtgatcggcaccatcgtgctgctgttccaggggctgttgctggcccatggcgggttgtcgaccctgggggccaacgtgttctccatggccatcgccgggccgtgggtggcctatggcgtgtggcgccttgccggccggctgggcgcgcccgccgccgtgacgattttcctgtcggccttcctgggcgatctggccacctatgtggtgacctcgttccagctggccctggccttccctgatgcccagagcggctttggcggggccttcgccaagttcgccggcatcttcgccatcacccaactgcccctggccgtggccgaggggctggtcaccgtggtggtgatgaacgcgctgcagagccgcatgacccccgtggaaggagccaaggcatgagcgcgcgcaccaattccatgctgctgggcgtggcggcgctgatcatcgccgcgccgctggtcctcaaccctgccggccagttcggcggcaccgacgatgccgccagcgaggtggtgacctcgtcccatcccgcctacgagaagtggaccgggccgttgtggcagccttccaaggaaatagagggactgctgttcgcggcgcaggccgccttcggggccggtctgctgggctacgtcatcgggcggcggcacggtcgttccggcaaatgagcctgaccattgaccgcctgtcccaggccggtcggtggcgacagcgggcgccgtcggaaaaggcggtactcgccctcggcctgctggccctggccctggtgctgccgccctggccgggcggagcgttggtgttgggcgccgcctggggactggccctgggcggggcaaggctccccccgggcgattggctgcgtctcaatctcgtgccgctgggcttcgtgctgaccggcgccgccaccctggcggtggattgggatgcccaggggctgcatctggccgccgaccagggtcgccgcgccgccgaagtggtgctgcgcgcctcggcggcggtgtcggccctgctgctgctggcggccaccactccggcgcccgatctggtgcgcggcctgcgccgtctgggcctgccgcccgagatcgccgagatcatgttgctgacctggcacttcctgttcctgctgcaggatcaggccaccgccatccgcaccgcccaggaggcccggctcggctggttcgggccccggcggcaagtgcgctccctgggcctgctgatcgcccagttgctgccacgcgccatggagcgggcacggcggctggaggtgggactggcggccagggggttcgacggctcgttgcccatgatctccaccgccaatccggcctcggtgccggtggtggcggtgatcctggggggcgaggcgctgctggcgggggtaagcctgtggctggcgtgatcctcgaggccgcgggcctcacctatcgctatcccggtggcgtcgccgccctgtccggccttgatctgggggtggagcgggggcggcgtctggcggtgctgggccccaacggggcgggcaagaccacgctgctgctgcacctcaacggcaccctgaagccctcggccggcacggtgcggctgggcggcgagatcatgggctattcccgcgcggcgctgaccggctggcgtcgccgggttggtctggtgctgcaagagcccgacgaccagttgttcgccgccacggtggccgaggacgtctcgttcggtccgctcaatctcggcctgtccgaggcggagacccgccgccgggtggaggcggcgctggacgcgctgggcatctcggatctggccgggcgggccacccatatgctgtctttcggccagaagaagcgcgtggccatcgccggcgccctggccatggagcccgaggtgctgttgctggacgagcccctggccggtctcgaccatcagggcggcaagcggctgctggcggcgctggacgccctggcccgggcggggaccaccctggtgttcaccacccacgaggtggacctggcccatggcttcgccgatcgggtggcgctgttccgggatggccgggtgatcgcccagggcgaggcggccgaggttctatccgaccgggagtgcctggcggcctgcgggctggagatgccgctgctgctggaactcggcgtgcgcacccgtgacgaagccctggccttgctggcggtggggcggaaggtgtattagcgatacctcaacaagtgaggttcccatgcgcatcctgaccaccgccgcccttctgctgtccctggcctgtcccgccctggccgccgaggtcaagtccatctcggctcccgaggcgctagcggccctgaagaagggcgaggtggtgctggtcgacatccgccagcccgaggaatggaagcagaccggagtgcccgacggcgcccggctgattcccatgcgccatcccgaggggggggccggcttcgtgcgcgacctgctggccgccaccaagggtgaccgcaacgcgcccgtcgccctgatctgccgcaccggcaaccgttccggcgccacggcgcgggcgctgtccgatgccggctttacccatgttctcgatgtttcggagggaatggcgggttcgggcgccgggccgggctgggtcaagcgcgagctgcccatgacccgctgcccggtctgctgaggaaatcggcacaaactcgactcgccgaaagattggtcttggtctaacgtaagccatggctgcccggccggctggtcggatctgggggcccggcgagggagaaaaccatgaagtttacgatcggtgcgacctgtctggcggtatcccttctggtgagcggcgcggctttcgccggcgccgatgatgccaagtgggtggccaagtgcatcagcgacaattccgatgccaaggtttccgtcgacatcgtcagcaagtattgcacctgcatgaacaataagatggacgacaacgagaccaagaccatcacccagtgggaaaagacccatcccgccgagatgaaggcttgcgaaaaggaagccggctggaagtaaccggccgcatacgcgacagggcgggccccaagggcccgccctttttgtttttaccgcagcgacgcctcgatattgccgccgtccacggtgacggtgcaggctgtgaccttggaggccttggccagccagacgaaggcgtcggccacgtcctcggcggtgacctcgcggcccagcaggttgccgcccatgtaatcctgttccgacaggcctcgcgccgaggagcggctcttgatcatgtcgtcggtgagcaggcccgagcggatgcggtcggcattgaccgcgttggagcggatgccgtccttgccgtgatccagggcgtattgcttcatcaggaacagggtggcggccttgggcaggccataggggccgaaattcttgcccggattgaccgcctgcttcgaggcgttgaacagcagggcgccgccggtgccctgggccttgaagacgcgcacggcattctgggccaccgcctgatggccgaagaagttcagttcgaacgaggcgcgcaaggtggaatcgtccacctcgccgaccgcgccctgccaggcggcgccggcattgctgaccaccacgtcgacgccgccgaagcgctcggcgacgcggtcgaaggcggcgcgcacgctggccgggtcggtgacgtcgcaggcgatgccaagggccttgccgccgcaagccttggccgccttggccgccgcgtcggcatcgcggtcgagcaccgccacttcggcgccctccttggcaaaggccttggcggtggccgcgccgatccccgagccgccgccggtgaccaccaccacctgacgggccaggggcttctcggcggccttgcccagcttggcctgttccagcgaccagtattccaggtcgaacagatcggcctcgcccaccggctcaaagcggccgatcgcctcggcgtcggtgatgctttccaccgtgttgacggcgatatcggcggcgatggccgcgtccttggcgcttgctccgatgccgaacaggcccaggccgggcaccagggcgacgcagggcttggggtcaagctcggtcttgatgttgcccagccgctggttgttgcggctgaaataggcgtggtacttggcctcgaaggactcgatggccgcctgcgccgcctcggcccattcggcggtttttcccgcctcgggggcgggcagcaccaccggccaattcttggtgcggatggtgtggtcgggggtcaccacgccctgctgggagtagcggccgatctcggcgccgtccacataggcgcggatagcgttggaggtgcggaagtccagaatccggcgcttggggccattggccagcaggccgcgcaggatgggcgccacctcggccaggggggcggggtccttgggcaggcccgtggcggcgaccaggggcttgcggcccttttccagccgctgctcggccagggtgaccatctcgatcatcagctcataggcggtcctggcattatcggcgaaggtgaagatgccgtgcttgaccaggatcagcccctccaccgtggggtcctgctcgtagatttcggccgccttcttggccagggcgaaacccggcatgatgtagggtacatagcccatgcgcgtgccatagacctcgcgggccagggcttcgccgtcgggctggtccaccagggacagcacggcggtggaatgggtgtggtcgatgaacttgtgcggcagaaagccgtgcagcagcgtttccaccgaggggttgggcgaggccgagttcatcaggttgccgcgctggtagtccaccatgtcctcgtcggacaggctgtccagccggcgcagcttcagcagcggggcaaggcgtacggcgggcaggccggcgggctcgatatcgcccatgtcccagcccgaacccttgacgcacagcacctcgaccgtctcgcccagcaggtcggtgacggtggtcttgcatgaggtattgccgccgccatgcagcaccagccgggggtcgccgcccagcaggcgggtggtgtagacgcgcaatgccagatcgcggttgacgccttcgggcgcatagcgcgtgacgaaggactcggcatctgcatcggaccacagggatttcatggaggacctcggaacgggcgaaaatgggaggcgcgattattacgccatgttccggggagtgggaagaggaaggctcaggccggctggccgagggcgccggaattggggccgctgcgcaggcgctggacgatctgcagcgtcttgcgcgccatgttcacggtgatggcggcgtgctggtccggatgctccaggatcaccagagcctcgccctccaactcgtccagaatatcatcgcccagggtgtcgttcccaccattggcgcccggcagcgtgtgcatggcatccccgcagaacctatccgcaagaagtaggtatcatacgaaggagtaaaaatgctactgctttttgttcaagcttatacttgcgtatagggcgttgagcgtattctcgacggcttcggggtcgaggcggatatccagccacgacatgccccagtgcagatgagggccggtggccaggccggtggcgccgatggcgcccaccagatcgccccggcgcaccttggctccggcgaccacgtccagccgcgacaggtgggcgtagctggagatcagccccaggccatggtcgatcatcacggtgcgcccggtcaggaacagatcgggcgcggccaggacgacggtgccgtcggcgcaggcatgcaccggcgcgccggccggggcggcgatatccaggccggaatgcggcgccccgccatttccgttatagactcgctggctgccgaacacgccggagaccgggccgtcggccgggcgcaggaatccgcccaggtactggggctccggggtgatgcgctcgcggatggcgcggaccatggccgcctcggccttcaggcgggccagggaggcggcatcgggttcggccttttcccgcggcaccccttcgatgcgctgaatccgccagtcccgacgcgagacggccagggcgcggacttcggcgcgtccatcgggcagggcgatcagcaactcggccgtggcggcggcgtcgcggccgaagcccagcaggaagcggccctggcggtcgaccggcaccggacggctgtccaggctgacccgcgccccgggatcggtggccccggccaccagtccgccctgctcggcccggccggtcagcacggttccggcggcggcggaacaggtccagacaagggaaagcagcaggacgacagccgccattgaggcggcggccaagcgcgctgaaggcgcgcgcccggcgagggactgacataaaccaggatcattgcgcgtcatatttgacgctcaatgatctatttcggcgcccacatgagcgtggcatcgccgcctccgtccttgttgcacaattctgtgatgatggccgacgacacccgggtgggggtgacgccattgacgctgagcaggcccttcttcaccagcttcatgcccgacgccgagcagatgcgcggcggaacccgttcggcgatgaccaccggcacgccgttcatggaggtcacccggatggcgccgccgaacaggtgggacggcggcgcgttgccctgggcggattcgaccatctgggcgacgaagcggtcggtttcgctgctggtgctctcggccggctcctgcgagcggctccaccagatatagccgccgatggccagagtcagggcgaccagggcggcggcggcgatgcgcagtccgcgcccctcctcctgctcttcttccgtgacgcggtgatggggcggatggaacttgccgtccttactttgggcccagttgtcggtgaccgagcgcggcaggcgctgttcctttgcggcgcgcagcacctcgatgcagccccgcgccgcgatgcgcatctcgttgcgctgaacctccggggtgtgcccgggcttgacctcggccatggactcctgcacccggcgccgcaaggcggcgcgcagctccttgtcgaagggacggcgcagcatcaggtccagcgccagcagggtcagctgctccagcttggccggattggtcacgccgggcattttcaggatgatggcttggaacagggcctcctgttcctcggtggtcgccggcttctccacgggatgatccatcctgtccgtcctgcaacccactccccatcgtccttaaggtagctccggtggcgttaacgaggtgttacccatattctccacaaaaaatttgtcgttgtgaataattctacacaatgccatatcagattgacgagcggggggttccgctgatcctgaggcatttcaaaccatgagtgtggacatgacgcatccggcccttgggcatggcctttccttcaacgacctgtatcagcgccctggcctggaacgggttgacgccgccttcctgggtgcgctcgccgccgccgacgaggccttggccggacgcctcaaggccgcccgcgccgagccgggtgccctggcgcccaaggacgaatcggcgctgctggtcgagctggcgccccatctggacgatttcctggccgagctgttctccatccgcgccgccgccggcgagttgagagcccgccaggacaccctggcgccgctctatcaggccaagcgcctgttcgtgcagcgccgggccttgaaggacatcaagccggacgaggccgccaccctggacgcccgcgccctggaaatggaatacgcgctgaaggtgggcgagcccttctcggaagccggtttcgcccggcgcgtcctggcctggatggacgacgaggccgcccatggcgaagagctgaagctggccgcccgtctggccgccgccaaggtggccgccaatgacagcgcctatcatccccacggcatcctgttcaaggtgccggccaagcacgatcccctgcatcaggtgccggtggtcaagggcgacgtgtgcggcgtgccggtcctggaattcgaggccgggcggctgcgccgccgcgagggcttcaacctcaccgatgccggcaccgatctggccggggcgctggacgagatcaattactgtatcctctgtcatcaccagggccgcgattcctgctccaagggcatgaaggacaggaagaccggcgagaccgccaagaccgccctgggcgtcaccatggaaggctgccccctcgaggagaagatctccgagatgcacgaggtcaaggccgccggccacgccctggcggcgctggccgtcatcgtggtggacaatcccatggcggcgggcaccgggcaccgcatctgcaacgactgcatgaccgcctgcgtctaccagaaccagaaccgcgacccggtcaacgtgcccgaggccgagacccgcaccctgaaggacgtgctggagctgccctggggcttcgagatctattccctgctgacccgctggaacccggccaatatccgccgcccgctgcctaagcccgattcggggcgcaaggtgctggtggtgggcatggggccggcgggctacaccctgtcccatcacctgatgcaggacggccaccatgtggtggcggtggacggcttgaagatcgagccgctggcctcggacctgtcgggcgtggacaccttcggccagagggtggccttccgccccatccgcgatatccgctccctgtggcagcccctgggcgagcgcgtcatgggcggcttcggcggcgtcgccgagtacggcatcaccgtgcgctgggacaagaacttcctcgacgtcatccgcctgctgctggagcgccggtccgagttcgccctgttcggcggcgtgcggttcggcggcaacctgaccctggaggaggcgttcgcgctgggcttcgaccatgtggccctggcgacgggagcgggcaagcccaccatcctcgacatgccgggcggcctggccaagggggtgcggcaggcctcggacttcctgatggcgctgcaactcaccggcgcggcccgcaagggcacgctggccaatctgcaattgcggttgccggtggtggtgatcggcggcggcctgaccgccatcgacacctgcaccgaggccatggcctattaccccatccaggtggaaaagttcctgtcgcgccacgaacagctggtggcggaaaaaggcgagcacgcggtgcgggtccactggtccgaggaagagcacgcgatcgccgacgagttcatcgcccatgccgaggccatccgcgccgagcgccgcgccgccagtgccgagggccgcgccccgcgcatcctggaactgctgcaatcctggggcggggccagcgtggtctatcgccgcggcctgaccgacagcccggcctatcgcaatcacgaggaaatctccaaggccctggaagagggcatccgcttcctcgaaggcatgagcccggtggcggtggagaccgacgatttcggcgccgcccacggcattcagctcaaggaccgcgatggccaaccgcaccggctgcccgcccgctccgtgctggtggcggcgggcaccgtgcccaacaccacccccgcccgcgaggccaagggcatccacctggacggcaagtacttccaggcggtggacgaggacgggcaggcggtcactcccgaccgccgcaccaagcccggcgccgttcacgtgctgatgcatatcgacggccatgaccgcacggtcagcttcttcggcgatctgcatccgtcctatgccggcaacgtggtctcggccatggcctcggccaagcagggccatccggtggtgacccgcgccatggagcgccggcccgccaatccggtgccggcctcccagttgttcgccaccctcaacacccggctgcgcgcccgggtgcacgcggtcaaccgcctgacccccaccatcatcgaggtggtgatcaaggccccggcggcggccgaggccttccgtcccggccagttcttccgcctgcagaacttcgagatgctggcccgcaaggtgggcgagaccaccctggccatggaaggtttggcgctgaccggagcctgggtggataaggagcaggggctggtcgggctgatcgtcctggaaatgggcggctccagcgatctgtgcgcccatctcacccccggcgagccggtggtgctgatggggccgaccggggcgcccacccatgtctgcggctcggaaaccgtgctgctggccggtggcggtctcggcaatgccgtgctgttctccatcggcgccgccttccgccagcggggctccagggtgctgtacttcgccggctacaagaatgcccatgaccgtttcaaggtggccgatatcgaggccgccgccgacgtggtgatctggtgcgtggatggcggcgaggcctttgcccccaaccggccccaggaccgcgccttcgtcggcaatatcgttgaggccatggtggcctatggcgagggccggctgggcgagcagaccattcccatcaccgacgtggaccgcatcatcgccatcggctcggaccgcatgatggcggcggtggccaaggcccgccacgaccgcctcgcccccttcctcaagcgcgagcaccagggcatcggctccatcaactcgcccatgcaatgcatgctgaaggaggtctgtgcccagtgcctgcaaaagcacaaggacccggtcaccggcgaggagaaggtggtgttcacctgctttgaccaggaccagcccctggacaaggtggacttcgccagcctggccgagcgcctgggccagaactccacctgggagaagctgggccgggcctggatcgaccgctcgctgcggcaggcggggttgcggggttaattcaaggccatgtgcagtgcgccgcgcaatgcgatgccggccagggagcccagcacggcgggcttccacacccgggccgtccgggggccggcggccatcagcaccgccaccccgggaaagtccaggggatggatcaggatgcccgcccaggtgttgagctgggcgggcgacagatggccagcgcggacctgctcgtccaccacgcccagcatggcggtgccgcccgccagatacttggtgacggcgggcaggaccagatcgggatcgacgaagggcagggcattggtcagcgcctggatggcgccggcctgccgcagagcggtgaccaccgtcagcgacaccaccagcatgggaatggcgctgatggcgatgcggaaggcctcggcgccggcccggttgatgacgtcgacaacgcccttggcgttctcggccacggcgtgcttcagcgtctcgtccagcacctgctcctcggccgacagagtccgcccggccacgtgataggcgatggcggcggcgagcaatccgcccaccagcgaaacgcccagcaccggcagcacatgcagaccgagggctcccaggggaaaggcggcgttggcctgggccatggccagcaccatggcgaaggcggcggccagatggcggtccgaggtgccgcgctgctccatcatggccagggtggcggccggggcggcgaagctgacgaagctcacctggatggcggcgaaggtggccagcccggtcaggccgaaggggcgcaggacgggggtcagcctcgccaccagccagtccaggacgccccaggcctccagcagccgcatcatggacagcatcaccaccatgatgggcagcagcacgaacagcgacagctcgatggccgagcggccggcgggcaggatgatggtgatcaggctgttcacagcaaccgcttcagctcatagaccagatccagcgcctgtcgcgccgtcaggtcgtcgggattgaccgccttcagcgcttcttccagcggagacgcctgcggaagggccgtggcggcgggcctgggcttggccagtgctgcgaacagcggcaggtcgtcggcgagccgtgccatgcctgaggcctgatccgacttttccagaatgcccagcacctcctcggcgcggcccaccacggcgggcggcagcccggccaggcgcgccacatggatgccgtaggaacgatcggcggcgccggcccccacctcgtgcaggaagaccacgtcgccctgccactccttgacccgcatcatgtggcacgacagcgccgccagacgcgaggtcaggcgggtcagctcatgataatgggtggcgaacagggcgcggcagcgattgacctcgtgcagatgctccaccaccgcccaggcgatggacaggccgtcgaaggtggcggtgccgcgcccgatctcgtcgaggatcaccaaagcgcgcggcccggcctgattgagaatggcggcggtctccaccatctccaccatgaaggtggagcgcccccgcgccagatcgtcggcggcgccgacacgggagaacagccggtcgaccacgcccatatggacggattcggcgggcacgaacgagcccatctgggccaggatggcgatcaccgcgttctggcgcaggaaggtggacttacccgccatgttgggaccggtgaccagccacagacgctgggaatcggccagatcgcaatcgttggcgacgaaggggcctgaccgggcggcctccagcgccgcctccaccaccggatggcgggcgcccctgatgtcaaaggcggtgctgtcgtccacccggggccgcgaccagcgtgccgaggaggccatctcgcccagggccgaggcgcagtcgagaccggccagggcggcggcggccagggcgatctcggcggcgcgggccgtcacctcgccgatcaggtcggccagcaattccatctccagcgccagggcgcggtcggcggcgccggtgatcttgccggccagctcgatcagctcggtggtggtgtagcgcgccgcgttggccatggtctggcggtggatatagccctcgcccagccggtcggcctgcttggacggcacctcgatatgatggccgatgatgttgttgtggcggatcttcagcgacgcgatgccggtctcgtcctgatagcgcttctccaggcgcatcatcaggccgttgctctcggtcttcagacccttcaactcgtccaggccctcgtggtagccctgggcgatgaagccgccatcccgcgcattcagcggcaggtcgggggcgagggcgcgctggagccggtccaccagggccgaatgctcgcccagttcgcgggcgcattggttgatgccgggcggcgtgtccaggtgggactgggtgaccagcatgcgcagcgccgggatctcggccagggcgtcgcggacattggcgaggtcgcgggggccgccgcggcccagcgacaggcgcgacagggcgcgctccacgtcggggcagcgcttgagcgtctcgcgcagttgggcccgcacgctctcgtgctcgacgaagaagcccaccatgtccaggcgccattcgatggcgtggggatcggtcagcggcgccgccagttgggcggccagcagacgggcgccggcccccgtcaccgtgcggtcgatggtggccagcagcgagccccggcgctcgcccgacagggtctcggccagctccaggttgcgccgggtcgccgcgtcgatctccatcaccgcgccctcggccagacgcttcgggagtgacaggcggggcagcttgcccttctgggtcagctccacgtaatccaccagggcgccgcccgccgccagttcggcccgcgaaaaggcgccgaagccgtccagggcgccgacgccgtacagggcttccagccgccgccgggaattctcggaatcgaagcgggcggtgggcaggggcgacaggacgttcttccaatcggcccagacgtcgaagaagtccgcagcccccagcaggcggtcggacaccagcaactcgccgggcgacaggcgggccagggcggcggccagggtcttgggggcgatggcctgcatggcgaagtcgccggtggagacatccacccaggcgagacccagcgtcccctgggcttcggccaccgctgccaggtaattgtgggaccgggcgtccagcagggtgtcctcggtcagggtgcccgccgtgatgacgcgcaccacgtcgcgggccaccaccgatttggagccgcgcttcttggcctcggccgggtcttccatctgctcgccgatggccaccttgaagcccgaccgtaccaacttggcgagataggcctcgtaggcgcggaccggcacgccgcacatggcgatgtcctcgccggcgtgcttgccccgcttggtcagcgcgatgtccagcgccgccgaggccttgaccgcgtcgtcgaagaacagctcgtagaaatcgcccatgcggtagaacagcaggcaatcgggatgggcccgcttgatggccagatactgggccatcatgggggtggcgtcgtctggaatggggggcgtctcgacggtcacggcgggtctatcgctgcagtaagggaaaccgggggcacagtaacacggacgtcatggcgcgcaagtgctgccccctttgcagactcccgctttcggcgcacaatggatacccaaaggtcgacacgaggagaatcccatgaccgccgcccttaaaccccgccccggtgccctccgcgaagtggtgggtacctttgccgaccgcgctcatttcgaggcggcggtttccgccctgctgaccgagggattcggccgtgacaagctgtcggtgctgacctcccacgattccctggatgccgccgagggcccggccggggccaaggcgcgcaagtggcgcgacggcctgatcgccctgatgggcgagctcaagtatgaaggccccctggtagccgccgggctgatcgccctggccgccggcccggtgggcgcggtgatcgccggcctggtggcggccggcgtcggcagcgtggcggtcaaggaagtgctggacgaagtggcagccattcccgattccgacggattcgtccgcgccctggcggcgggcagcgtgatcttgtgggtcgccaccgattccctcgacgaggaagccaaggtacgcgccctgctggacaatgccggcggcgccaacatccacatcttcgaacgcgccaaggggacgcggcattagcaggatatccggggggggacgcggtcattccccgggcgttccaatgccggaacaagacgggacgggcaacgtcccgacgtcaggtgagatcagggaagcgagacgacatggccagcaatttccacaccgaggcttcgcgcaacaccgaagccaagggcaacgatacccttgagcgcgacacccttctgatgcatgcctcgggccgcccgggcaagatcgaggtggtccccaccaagccgctggccacccagcgcgacctgtcgctggcttattccccgggcgtggcctttccctgcctgcacatcgcccgcgatccctcgttggcctacgattacaccgccaagggcaacctggtggcggtgatctccaacggcacggcggtgctggggctgggcgatctcggcgccctggccagcaagccggtgatggaaggcaaggcggtgctgttcaagcgcttcgccgacgtggattccatcgacctggaagtcgatacccgcgacgtggacgagttcatcgccgccgtgcgttatctcggccccagcttcggcggcatcaacctggaagacatcaaggcgcccgagtgcttcatcatcgagcagcgcctgcgcgagctgatgcccattccggtgttccatgacgaccagcacggcacggcgatcatctcggccgccgggctgatcaacgcgctcgacctcacgggccgcgacatctccacggtcaaggtggtggtcaacggcgccggggcggcgggcatcgcctgcatcgaactggccaaggccatgggcgtacgccacgagaacgtggtgctgtgcgacaccaagggcaccatctaccagggccgcaccgagggcatgaaccagtggaagtcggcccacgccgtccccaccaaggcccgcaccctggccgaggcgctggacggcgccgacgtgttctacggcctgtcggtcaagggcgcggtgactcccgagatggtggccgccatggcggccaagcccatcatcttcgccatggccaatcccgatcccgagatcaccccggaagaggtgaaggcggtgcgctcggacgccatcgtcgccaccggccggtcggactatcccaaccagatcaacaacgtgctgggcttcccctacatcttccgcggcgcgctggacgtgcgggccagcaccatcaacgacgccatgaagatcgccgccgcccgggccatcgccgccctggcccgcgaggacgtgcccgacgaggtggacgccgcctattccggccgacgtctgcgctatggtcccgactacatcattccggtgcccttcgatccgcgcctgatcgcctccatcccgccggccgtggccaaggccgccatggattccggcgtggccagaaagcccatcatcgacatgggcgcctacaagcgcgagctgtcggcccgcctcgacccggccagcgccggcatgcagaccatcaccgacgtggtgaaggccaatcccaagcgggtggtgttcgccgagggcgaggaggaaaagcagatccgcgccgccgtggccttcgccaatgcgggtctcggccatcccatcctgctggggcgcgaggaccgcatccgcgagaccatgaagaatatcggcctgccggcggccgaatccctggacatcatcaactcgcgcatctcgccccgcaccaaggcctataccgacatgctgtatgcgcggctgcagcggcggggcgcgctctatcgcgacgtccagcgtctggtgaaccaggagcgcaatattttcggctcgctgatggtgcagtcgggcgatgcggacgccatggtcaccggcctgacccgcaattactggcaggccttcgaggagatcaagaaggtcatcgaccccacgccgggcgagctgatgtttggcatgacggtattcgtggtcaagggcaagctggtcttcgtcgccgacaccacggtgatggagacgcccacgccgcagcaactggccgacatcgcggtgcagacggcgcacaaggcccgccagatgggccacgagccccgtgtcgccatgatcagctattccaatttcggcaatcccagcagcgagcgctcggaccgggtgcgcgaggcggtggggctgctggacgcccgcaaggtggatttcgtctatgacggcgagatggccgccgacgtggcgctggaccccgaactgctcagccatttccccttctgccgcctgaaggcgccggccaatgtgctggtgatgccgggcctctactcggcccacatcgcctccaagctgctgcagaagctgggcggcaccagcgtcatcggccccatcctggtgggcctgtccaagccggtccagatcacctccatggacgcctccgccaatgacatcgtcaacatggccgtgctggccagctacgatgcggtgcgctgagcggaaggccgcgtggtgatccggggaaccgtcaccggcggccgtgtcctgctgttcgccctgttcctgtccagtcccaccgccatcatgctggtggtgctggccggggccgggcgcctcgacgtctggcccgccatcggcacctgggtgatggtgacctcgctgctgctgccgctggtccgctcccatctgggcgaattgtcggggctggccaattgggtccgcaccctggcccatggcggcgacatcgccaccgccccggccaaggacggcatggccctggccgagatcgccgccgccgtggcggcgctgcggcggctgtggcagcaccgctctgccgaactggccgagacggcgcgctggaatgccagcctgctggagaatctgcccgatccgctgctgctgctggactcaagccgccgggtggtgcgggccaaccgggccgccacccgcctgttcggccgggacccggcggggggcgatctggccgccgtgctgcgcgatccccaggtcaccgaggcggtgcaggcggtgctgtcgggggccgcgccgtcgcgggaatgcgagttctcccaggccattccggtcgagcgcacctttgcggcgcgcatcgaccgtctggacggccagccggccttcgaggcggccatcgccctgctgaccctgcacgaattgaccgccatccgcgccatggagcgcatgcgggccgatttcgtcgccaatgccagccacgagctgcgcacccccctggcggcgctgtcgggcttcatcgagaccctgcagggaccggcccgcgacgacgaggaggcgcgggagaaattcctgggcatcatggccgagcaatcgggccgcatgagccggctggtggccgatcttctgtccctgtcgcgtatcgagctggacgagcactcggcacccagcgaggcggtggatctcgcccggctggccaccagcgccgccgaggcgctgcgccccctggccagcccgcgcggcatggacctggaggtcaccctggccgatggcctgcccccggtgaccggccagtcggaccagctggcgcaattgctgcagaacctgatggaaaacgccgtcaaatacggcaatgacggaaccacggtcgaggtcagcgtcaccctggccggggatctgccggcgggagcgggggcggcgttgcgcgccggcccggtggtcaagctggcggtgaaggaccatggcgagggcatcgccgccgagcacctgccccgcctgaccgagcgcttttaccgggtggacacggcgcgctcgcgcaagatgggcggcaccggcctgggactggccatcgtcaagcacatcgtcagccaccatcgcggcctgctggccatcgacagccgcccgggcgagggctcgaccttcacggtctggctgccggccgcaccagcctgagatagaccagcagggacagcagccccatcaccgccaccatggcggccagcggccgtgccgagccgtcgtagagcgtccccaccagccagccggccacggcgccgccgctcatctggatgaagcccatggccgaggaggcagcccccgccgcgcggggaaagggcgcgatggcgcccgccgtggcattgggcagcaccagggcgcaggaggcgaagaacgccatcaccggccccatgatcatgacgatccccgcgatgccgcccggcttggccagccccgaccacaccagggcggccagggtgacgccggcgatggtgcaacccagggtgccggtgaacaccatgcgttcgatgccgaagcggtgggtgagcctggccccgatgaacccgcccaccaggaatccggccgaggcgaaggcgaaggccaggccgaaatggcgcggctccatgcccatgacgtcgatcagcacgaagctggacgccgagatgaagctgaacagcccgccgaacgccgccgtcatggtcaagacatagccgaggaacaggcggtgggtcaggatctcgcggtagttttccagcatgcggccgagatcgagggcggccgggtccttgtgctggttggtctcgcccagcatgcgccagaccagcaccagcaggatgacgccgaacagggccagcagcaggaaattggagcgccagccgaacagggtgtggaaccagccgccgacggtgggcgccaccagcggggccaacgccatggccgaggccatgtagctcatcaccttggccgcctggtcgcgggcataaaggtcgcgcaccacggcgcggcccagcacgggcccgcagcaggcgcccaccgcctggaagaaccgcccggcgatcagggcctcgatggagggggcgaagacgcaatagacgctggccaccacatagatggcgacaccgcccagcagcagcggccgccgcccgaagcggtcggacagcgggccatagaccagctgcatgacggcaaagccgccgacgaaggccgacagggtcaactgcaccatggtggtggtggtggccagatcgcgggccatgtcgggcagcgaggcgaggtaaagatcggtgcagaccggcccgaacgccaccagcagggtcagcagcaccgccatgcgccgcgagggtgatacggtattcaacaagatcccccgtaacggtgcaattgcggcccgtggcgtttcagccagtcgcgcggtgccttgcagtctccggccagtccttcgaccagcgcccagaaatccgggccgtgattcatctcggccagatgggccacctcatgggcggcgacgtaacggcccacccagtcgggggccatcaccagccgccaggaaaaggacaaatcgccccgggccgagcaactgccccagcgcgaggtggtgtcgcgcaccgagatacggccgggcttgcggcccaaaagggtcgccaactggcggcaatggtgggccatgaccacgcgggcttcgcccttcaggaaatccgcgacccggcggggcaggctttcgggagggccggagacgtggatcaccccgtcctcggcccacacgccgcgccgcgcctgaggctcgtgggtgatgcgatgggccacgcccagcaacggcacttcgccgccatgggcgaaggggacggggccgggcagaacggcgaggcggctttcgacccaggcggtctggctgttggcgaagcgcagggcctcgcgctcgggcaccccgtcgggcagcaccaccaccaccgacccgccgccggaatcgaggcgcaggctcatcttgcgcgcccggccggaccgcttgacgacgaggggcaagctgcgcccgtggaggtggaggagaaaagcgtgacccatggcctcctcatatcgtgatcggggcgaaggagacaagccctggtctggtcttgcccccatgcgccccgtctgcgacagtccgcccatgaccaagacacccgccatcatgctgcaaggcaccggctcggatgtgggcaagtcgctgctggcggcgggcctgtgccggctgttcgcccgccagggactggccgtgcgcccgttcaagccccagaacatgtccaacaacgccgccgtgacggcggatggcggcgagatcggccgcgcccaggcgctgcaggcccgcgcggcaggcatcgagcccggctcggacatgaatccggtgctgttgaagccgcaaagcgagaccggtgcccaggtggtggtgcagggtaaggtcgtcgccagcgccacggcgcgggactaccacgccttgaagcccaccctgctgccccgcgtgctggaaagctacggccgcctcgcggcgcaagccgacctgatggtggtcgaaggggcgggaagcgccgccgaggtcaatctccgcgccgccgacatcgccaatatggggtttgccgaggccgccgacttggccgtcgtgctggtggccgatatcgaccggggcggcgtcatcgcctccatcgtcggcacctgggccatcctgccggaagccgagcgggcccggctgaagggctatgtcatcaaccgcttccgcggcgatcccgcgctgttcactccggcgctggacatcatccgcgacaagaccgggctggactgcctgggcatcgtgccctggttcgccgaggccgccctgctgcccgccgaagattccgcctcgctcggcaaggggaaggtgggcgatggagccgtgaagatcgccgtgccgcgtctttcgcgcatcgccaatttcgacgatttcgaccctctggccgccgagccgggggtgagtctggagatggttgcgccggggcgcccgctgcccctcgatgccgatctgatcatcctgcccgggtccaaatccaccatcgccgatctggaattcctgcgcgcccagggctgggacatcgacatcctggcccatgcccgccggggcggccgggtgctgggcatctgcgccgggttccagatgctgggccaaagggtttccgaccccctgggcgtggaaggcccggcgggcggcgtggctgccggcctggggctgttgcgggtggagacggtgatggagggcgacaaggtgctgcgccgcgccgccggcaccgatgctgccggtcatggggtgacgggctacgagatgcatatgggccgcaccaccggtcccgatgccgcccgcccgttcctcaccctggagggacggcccgacggcgcggtgtcggccgacgggcggatcatgggctgctatctgcacggcctgttcggctcggattcctttcgcgccgccttgctggggcaggggagcgggctggcctacgagcccatggtcgacggtgtgctcgaccatctcgccgaccatctggaacggcatctggacatggggcggctgcggctgatctcaggcctgtagccacagggccaggatcaccagccccacctgaagcaggcaggccaccgtataaagatgcaaggcccgctgaatgtcggcgggttccgcccgggcgcggcccgttccgatccacttttcgtccacggtcagccccggatatttgcgcggcccccccagggccagacccagggcgccggccgccgccgcctcgggccagccggaattgggcgaacggtgatggcgggcatccctcagcatggtgaccagggcgctccacggacggcccctcggcacgaagggcgcggcgagaaccagcagcagcccggccagccgggccgggatcaggttcagcaggtcgtccagccgggccgaggccatgccgaaggcccggtacttgtcgttgcggtggccgatcatggaatcggcggtgttgatggtcttgtacagcagcaggccgggcaggccgagaatggcgtaccagaagaccggcgccactaccccgtcgccgaaattctcggccaggctttcgatggcggcgcggaccactccgtgggaatccaggctttgcgggtcgcgtcccacgatgcgcgacacggcgtagcgcccggcctccagcccgctgtccttcagggccatggccacgtcgtagacatgctcgaacagcgagcgctgggccagcagggtggcggcgacgaagacctcgaacagccaggcatggggcagggtgcgggccaggaaggccatgatcgcgccgagtcccagggcgccgaggccgaggcccagcgccaccaggatgccgcggcggcggcggtcggcctcggaccgatccggccggttcaggcggcggtccaacaggccgataacgcgcccgatcagcaccaccgggtggggcaggatgcggaacagcggccccatctcgcccagggtggcgtcgacggccatggccatgaacagcagcatcagcccgtcgggcgcgtgggtggaatgcatgaacagcggaaacatggagccaagattgtcggggcgggcgagccccgtcaaccgggatgatttggctggaatcgttcgggctctcccgcctatagtccgcgcttcaaaccggccggaggcatggaccagccgggcggctcgaaggcaaggaccagggcgagatgagcgagaagatcggtgtgatgttatgcggccacggcagccgcgatgtggatgccatccgggaattccaggcgctggccgggcatctgacccggcgcctgccccaatacgaggtggagtccggtttcctggaattcgccacccccatcatccgcaccagcctcgatgccctgaaggccaagggcgtgtcgcgcatcctggcggtgccgggcatgctgttcgccgccggtcacgtgaagaatgacctgccgtgggagatcaactcctttgccgccgagaatcccggcctgcccatcaccttcggccgtgaactggccatcgacaccaagctgctggccgcggcgcgggcccgcatcgaggaggccgaggccgcctcgaacgtcgccatcgagcgcaaggacaccttgctgctggtggtggggcgcggcaccaacgaccccgacgccaattccaatatcgccaaggtggcgcgcatgctgtgggaaggcatgggcttcggttgggccgagatcgccttttccggcgtggcctatcccctggtggaccaggccctggagcgggtgacccggctgggctacaagcgggtcgtcgtcttcccgtatttcctgttcaccggcatcctggtcaagcgcatctacgagtggaccgatcaagccgccgctgcccatcccggaatcgagttcctcaaggcgccttacctcaacgaccaccccctggtgatcgacagcttcgtcgagcgggtgggggaaatcctcgacggctcgcccgccatgaactgctcgctctgcaagtaccgcgaacaggtggtgggctacgaggcctcggtcggcgccgtccaggccgggcatcaccaccatgtgcgcggcatcggcaccgacgaggatcacggccatcatcatgaccacggtcacgggcatgatcacgatcatggtcaccatcacggccacggtcacgcctaccgcccccaccgtcacgactgaggcgttccatgggcgcctggatcagtgaccccgccgaaatctaccgccaaagcttcgccaccatccgggccgaggccgatctggcccgcatgcccaccgatctggccgatctggcggtgcgggtggtgcatgcctgcggcatgaccgacatcgccgccgatctggcctggagcgagggcgccggccaagcgggggccgaggcgctgcggcgcggcgctcccatcctggtggatgccgagatggtggcccacggcatcatccggcgcaatctgcccgccgacaaccgggtgatctgcaccctgaacgaggtgacccaggccgaggccaaggcggcgtccaccacccgttcggccctgggggtcgagaagtggctgccccatctgggcggcgcggtggtggcggtgggcaatgcccctaccgccctgttccggctgctggaactggtcgaggcgggcgccccccgcccggcggtgatcctgggcttcgccgtgggcttcgtcggtgcggtggagagcaaggacgccctgatcgcctcgggcctgccccatgtggcgctcaagggccgccggggcggcagcgccatggcggcggcagcggtcaacgccctggcggggggattgaaatgagcctttccgccctgtcatcccgagcctggcgagggatctccgcttggcggggcggtgcccatgctgaaaagccgtaccaggatgagatccctcctcccgttggtcgtcgggatgacatgccttgggagacgcttccatgatcaccgtgatcggcatcggcgaggacggtctcgacggtctttccgccgcagcccggactctggtcgatggcgccgaggtgctggtgggcggtgcccgccatctggcgatgattcccgccaatggtgccgaacggctgacctgggcctcgcccttcgccgacagccgcaccctgctggaagcccgcgccgacaagcgcatggtggtgctggccagcggcgagcccctgtggttcggcgccgctgtcaccctgacgggctggttcggggccgaccgggtgagcgtggttccccatcccggcgccttttccctggcctgcgcccacttgggctgggccatgcaggattgcctgttcctcaccattcacggccggccgctggactccctggcgccgcatctggctccgggccggcgtctgctgatcctggccgaggatcggaccagtccggccaaggtggtggccttgttggctcagcatggatacggggccagcccggtggtggtgctggagaatctgggcggagcggccgagcggatcaccgatgtttccggctgcgcctcggatctctgcgtggtggcggtggagtgccgtctggaccggggcgtccggcccctgtccaccgtgccgggcctgcccgacgaggccttcgagcacgacgggcaattgaccaagcgcgatatccgcgccgcgaccctggccgccctggcacccctgcccggtcaggtgctgtgggacgtgggggcgggctgcggctccatcgccatcgagtggatgcgggccggcggacaagccgtggccatcgagagcaagcccgagcgcctggaccgcatcgcccgcaacgcggcgcgcctgggcgtgccgggactggagatcatcgccggccgggcgcccgatgcgctgcccctggaccgcgagccgcccgacgccattttcgtgggcggcggggtgtccgaggccgggctgctggatatctgctggtcggccctggggcgcggcgggcggctggtggctaatgcggtgaccatggagggcgaggcggcgctggtcgccctgttcggcctgcacggcggcgagatgacccggctgtccgtggcccatctcgaccgggtgggcggcttccacgcctggcatccggccatgccggtgacccgctatgtggggtggaagaaatgagcgccaccctctacggcatcggcatcggccccggtgattcggagcttctgaccctcaaagcggtgcgcctgatcgccgaagttccggtgctggcctggccggcgccgctggaaggggacgggctggcgcgcaccatcgcggcgccgcatattccggcgggcaagacagagattgccatccgcatgggcttcaccgtggaccgtgacggcaccgaagcggcctatgaccgggcggcggaagaaatcgccgcccatctggacgcgggccgcgacgtggcggtgctgtgcgagggcgacccattcttcttcggctcgttcatctacctgttcgcccgcctgtcgccccgcttccccgtcgaggtggtgcccggcgtgtcgtccatcatggccgccgccgccgatctgcaggcgccgctttgcgcctgggatgacggcgtggccgtcattcccgccacccgtaccgaggccgagatcgaggcggcgctggcggcttcggacgccgcggtgatcatgaaagtgggccgccacctgcccaaggtccggggcgtgctgcagcgcctgggcctgtgggacaaggcccgcatcgtggaaagggtcggtctgccgggccgccgcgcccacgacccggccaccgtgaccgagcttccctatttctccctcatcctggtgcaccgcagaggaaacgcatggctttgaacattgccctggtggtggtgacccccgccggactggaaaccgcccgcgccatcaaggccgtgctgcccggtgcctcgatccacggcctgatcggccgggtggagggcgatgtggggttccaggacaccggcgcccatctgcgcgccctgttcgcggcgcgtacgccgatcatcggcatctgcgccgccggcatcctgatccgtgccttggggccggtgctgggcgacaagcattccgagccgccggtcctggccgccggcgtggacggctcgtcggtggtgccgctgctgggcggccatcacggcgccaatgccctggcccgccagatcgcccatgccctggatgtccgtcccgccctgaccaccgccggggaactggcgctgggcgtggcgctggatgacccgccgcccggttggcgggtgggcaatccggacgcggccaagtcggtgaccgccgctttgctggccgaggaggcggtggcgctggaggtggaggcgggagacgtcgcctggctggacggcctgcccttcgtggaaaaggccgagcacaccatccgggtgaccgaccggtcggtcgaattcgatgatcacgaactggtgctgcatcctccgaccctgacgctgggcgtggggtgcgagcgcaatgcctcggcacaggagctgatcgccctggtcaaggacgtgatggcccaggaggcgttgtcgcccaaatccatcgcctgtgtcgccagtatcgatctcaaggccgatgaggcggcggtgcacgccctggccgccgaattgggcgtgcccgcccgcttcttcagcccggccgagttggaggccgaggcgccgcgcctggccaatccctccgacgtggtgttcgccgaaaccggttgccacggcgtggccgaaggcgccgccctggcggcggcgggcgccgacgccaccttggtggtgcccaaggtcaagggggcgcgcaccaccatggccctggcccgttcgccccgggccatcgacgcccggacggtcggccgggcgcggggccggctgttcgtggtgggcatcggcccgggcacgccgcaatggcgctcgcccgaggcccaggccgccatcgaggccagcagcgatctggtgggctatggcctgtatctggatctgctgggctcggcggcgcacggcaaggagcggcacgaaagcgcgctgggtgccgaggaggcccgggccgcccgtgccctggacctcgccgccgaggggcgcacggtcagcctggtgtgctcgggcgatcccggcatctatgccctggccaccctggtgttcgagctgctggaccgcagggcgcgcgccgactggaaccgggtcgagatcaccgtggtgccgggcatctcggcgctgcaggcggcggcggcgcgggccggcgctccggtcaatcacgatttctgcaccatctcgctgtcggacctgctgaccccgtgggagagcatcgagacccgcctcaaggccgccgccatggccgatttcgtggtgtgcttctacaatcccgtctcccagcgccgccgcgaccagttgcccaaggcccgcgacattctgctgtcgggccgcggtcccgacacgccggtgatcctggcccggcagctgggacgccccggcgaaacggtggaggtcatccgcctcgccgacctggacgtggacaaggtggacatgctgaccatggtggtggtgggctccagcgagacccgcaccttcaccgccggccagcatgcctggacctatacgcccaggggctacggcaagaagatggtgtaatacggtctccgggcgggctgccgcccgcacccgcatggggcgatgccccatacccccttattttcaaatagatggagggccgggaggctttgcctctcggtcggggttcggggcggaagccccgaagtgttcaaacggagttcgcataaggggacgcttgcccctgctcctggacgtcgtatcattcccctccggtttttcatccgcccgagggaaccatgcgccgtgcctccaccctgcttgccgccctgctggcctcgaccctgctgacctcgtgccaggtggcaccgggcacgggcaagagcaacttcaacatcatgtcggccgaggaagagcagaagatgggcgccgaggcccatcccgacgttctcaagcaatatggcggcgtgtatgacgaccccaagatgcaggcctatgtggccggcatcggcaagcgtctggtcggcaataccgagacgcccggcgcccccttccgcttcacggtgctgaacagcaacatcgtcaacgccttcgccctgccgggcggatatgtctatgtgtcacggggattgctggccctggccgatgacgaggcggaactggccggcgtggtcggccacgagatcggccatgtcaccggacgccacaccgcccagcgctacagccagtccatcgccgccaatatcgccaccggcgtgctgggcgcggtggtcggcgccgtgaccggcgtgtcgggggtgggcgacatcgcccagctgggcgccgccgcctatatccagggctattcccgcgagaacgaaagcgaggccgacgagctgggcatccgctacatgagtgtcagcggctggaatcccgacggcatgaccaccttcctgggcaagctgcgcgaccaggcgcggctggaggcggtgctggccgggcgctctcccgacgaggtggacgagacctcgctgttcgccagccatccccgcaccctcgaccgggtcagggatgcggccaatctggccaagggagccgatcacaagggcgccatggggcgcgaccagtaccttgcccatgtggaagggctactggtgggcgacgatcccgacgagggcgtggtgcgcggccgggtgttctcccatgccgggctgggcatccgctacgaggtgccggccggcttccgcctgatcaacggtcccaaggcggtgatggcggtccacaaggacggctcggcgatccgcttcgacatgggggccgaggcccatggcgacatgaccaattatctccagacccaatgggccaagggaacccggctgtcctccatcgaggcgctggagatcaacggcctcgccgccgccaccggcttggcccggctcaacaccaacaagggcgctatggatgcccgcctgctggcggtgaagaacggcaagtccacctaccgctttctctacctcacgccgcccaacctgaccgccgcccatgcccaggagttcaagacctcgggcctcagcttgcgcaagctgaccgaggcggagaaaacggccatgaagccgctacgcctgaagatcatcaccgccaaggccggagacacggtggaaaagctggccgagcagatgccctacgaggaacacaaggtggagcgcttccgggtactgaacggactggccgagaccgagaccgtcaagccggggcagaagctgaagatggttatctgaggccaatcccgaacgtcagcgggccatggcgcgggccagcggcaggaactcggcgaccaccttgtcgtagagcactcgcttgaacgggatgatcagcgccggaacctcgtccagcgccatccagcgccagctttcgaattccgggtgctcggtctccaggttgatgtcgccgtccgtgccggtgaagcgggcgcagaaccacttctgggtctggccgcgaaagcgtcctttccagcttttgtcggcgatggcgggtggcaggtcgtaggaaatccagtcggcgctttcggcgatgatctcggccttgttggtgccgatttcctcctccatctcgcgcagggcggtgtcgcgcgggtcctcgccctcgtcgatgccaccctgggggaactgccaggcgttgccgggggtgtcgatccgctgggcgacgaaggccagcccctgggcgttgagcagcaccagcccgatgccggggcgataggggcgctggtcgtagggcagcggcgtcttatgcttcttgctcatgactttcccggggcgggtgggggttggaccagggtggagaccgggacgatcaccagcttctggccgtcgaaatcgttgagccagggcagcagccggtcgaaggacagcgggcggggattgatcaccaccagggccttgcccttggtccgcgccgcgatggacacctggttgaagcgcatttcgatggcttcgcggaacaggtcggcatcggcgaccgccgtcaccggggccagggcgggggtgcggtcggcgggggcggcgcccggacccacatagagcaatccgtggtcgcgcagcttgcccagggtctggacgatctgttccgaggcggcgaatttgtcgcccagcgaaatcaggccggtataggcgccgccacgggccatcaccccttccaggcgggccagattgctttccggcggcacggaattggtcatgcccagtgggccgggatcgcggggctgggcgccgctggcatcggcgggcagcaccatcatcacttcatggccgtaatcacgggccttcttcacccatttatccaggccctgcgcataggggctgaaggccagggtcacctcgggcggcagcttggcgatggcggcttcggtggcagccttgtccagccccatgtccatcaccaccaccgccaccttgccgcggtcggcggggccggaccacggccgggcgtagacctgccacggctgcttgccgtcgggcgacggcaccggcaggtcgccgatggccgtgcgcttttgcatctccttgttgggagcgggaggcagggccttcacttcgcccttgtgggccggcaggccctcgtagctgggaggcttttcggcgctgcgcggattgggctgggtgggcatgcccgaggaatccaccgccggcggcggcttgggggcgaaggccttggagaccggcgattccggctcggccacgtaatcgcccccgggcggcagcgtcactttcccatcgggcggcagcgccgcgaccttggcgtccggcttggcctccggtttgctcccgggggccgcctcggcaggtggcagggcgggcggcagggaatcgggggacggcgtgtcgtcgggcagcgccttcagcatctcgccccccggcggcgccgcacccggagccatgggaggggtcagcaatccgccgccggcacccggcttgggcggctcgccacggccgggcagttcgaaggacagcttgggcgggttctcgcccacatccatcatgccgatcatgtcgcgggtatcgaaggcggtgaacagataggccacggcacccagaccgccgccggccagcagaattcccaagccgatcaggatcggcttgaggttcagcggctttcgttcgggtttgatctcctcgacgacgatctcggggatctggtcctcgtccagttcctcgagatcgaagtgggtatcagcggccatgacgtggtgcccaagccccgcttaacgctgggccgggcggtataacgacaggccgcgcagcaggtccagcgcccgggcaagctggtagtcctgggccggatcgcccagcttgatgggggtgggggcctcggccttgccaccctcggccggggcgtcgggggccttggattcgggggcggccttgtccttctcggcgggcttggccttgtcgccgttgggattgggcagggccttgcgcaagctggcttccgagcggcgctccaccgccgcgccggccaccggctccaccttggactgggccgccttgatatcgggctcgatgcccaccgcctgaatcgaccggcccgacggcgtgtaataccgcgccgtggtcaggcgcagcgaaccgtggccgtgcagcggcatcagggtctggaccgagcccttgccgaacgagcgggtgcccagcagcacggcgcgcttgtggtcctgcagggcgccggcgacgatctccgaggccgaggccgagccgtcgttgatcagcaccaccagcggcaggccgtcggcgatgtcgccgggccgggcgttgaagcgctgggtgtcctcgggacggcgcgaccgggtcgagacgatctcgcccttgtccaggaagtcgtcggacaccgccacagcctggtcgagcaggccgccgggattgttgcgcagatcgatgacgaagccggtcggcgtcttgccgatatccttcttcaactgggtcatgatgcgtaccagatcggcgtgggtggtggcgctgaactgcgagatgcggatatagccgatatcgccatgcagctggcccttcactgtctggaccttgatgacggcgcgggtcagcttgatgtcgaagggctgttccaccccgccgcggcgcacggtcagcttgatgtcggtgttgacggtgccgcgcatgcgatccaccgcctcggacagcgacagcccctgaacctgttcgccatccaggtgggtgatgaaatcgccgggttgcatgccggcacggtaggccggggtatcgtcgatgggcgagaccaccttgacccagccgttctccatggtcacttccaggcccagcccgccgaactcgccgcgggtttggatgtccatgtccttggagttcttgggattgaggtagctggaatgcgggtccagtgaggccagcatgccgttcagcgccgcctcgatcagatcctcgtcattgacgggttccacatactcgctgcgcaccttttccagcacttcgccgaacaggtccaacagcttgtaggtttccttgcgctcggcggcggaaacgggggtgagagcggtcgtcgacagcagggcgaaggtccccgccgcgatcagaatcttgcgaatcatccactagccttacttttttgtgccatgagccaaggcaacgggttgaccggctggccattgcggcgcagctccacgtaaaggttgggcttgctgtcgtcctgccccatgacgccaacgggttcgcccgtcaacagcttctggccgacggtgcagtcgatctgcgccattcccgccagcagcgtatgatagccctcgctgtgttcgatgatcaagagaaggccgtaacccctgaacgggccagcaaaagccacgtgcccatcatagggggcgatgacctgagccgccttgcgggtgttgatggtgatgcccttggacacctgtcccacgtcgttgggctggccataggtctcgaccacccggccacgggcggggaagggcaggcggccctgggcctggctgaagggcttgtcgttcttcacagggcggctggcggcggcttcgcgggatgccagttcggcgtcatgggtggccttttcggcggccagctgcttctctttggcttccgcctgagccttcagttccgcttcctgggcgaggcgggcggcggtgtcctcgcggaccctggcctcggcggcggcctgctgggcggccttgctggccgcttcgtcgcgggccttggcttcggcgacggcttggcttgccgccttctgcgccgccagttctgcgtcgcgggctgcgcgttgggcggccagttcagcctcgcgggcgaggcgccgcgccatggcttcggcctcgcgggcggttttctcggcggcggccttggcggcggcctcggccagacggcgctcgcgctcctggtccaggcgcgacagcagatcgcgcagatcctcggcctgggcgcccaggtcctggaggcgggcctccagcgagcggcgctcctgctcggtggcgttctgaacctggaatttgcgttcgaacatgtccttgatgcggacgtgttcgcgctcgagctgggcggtggtgctggcgatcaaccgacgctgttcgccgatttcggtgcgcagcttggcgacgccgtcgatctcgacgcgcaggtcgcgggccgactgctcgatctggggcacggcggcacgcagcagaatggccgagcggacggtgtcggccgggctctgcggctgggccagcagcgcctcggtgggccgccaggccaggcgctggagcgcggtcagcacgccgaccatctggcgcgaacgccggtcgagggcctctgagcggctgatctcgcgctttctcaggtcgtcgaactgggcttccagttccgagagcaattcctcgctctcctgggccttgccggcggccttgaccatgtcggtgcgcaggcgcgccgtctcggcggacaattcctcggccttgcgccgcacatcctcgtgctcggcgcgtgagcgctccaactggccttccagttcccgcaggcgttcacccgcatccaccgggcggtcccaggttgctgaagcgggcgccgctcccagaaggagcagcgccgtcgcgaggagggcccccctaaccggccgcacggagggtcgggcggagcagggactgcccgctcatttcggccggttgggccagccccagcagggccagcagcgtgggcgccacgtcggccagccggccgtcgccgattccttcgatgccggcgggcggagcgaccagcacggccgggaccgggccggtggtgtgggcggtgtggggctcgccggtggtggggtccttcatctgctcggcattgccgtggtcggcggtgaccagcatggtgccgccggccttggcgattgcggcctccagcctgcccaggcaggcatccaccgtctgcgcggcgacgatggcggccttgaggaagccggtatggccgaccatgtcgccattggcgtagttgaccaccaccacgtcgaagacgccgctttcgatggcggcgaccagcttgtcggtgacctcggcggcgctcatctcgggctgcaggtcgtaggtggcgaccttggggctggggaccaggatgcgctcctcgcccgggaacaccgtctcgcgcccgccgttgaagaagaaagtgacgtgggcgtacttctcggtctcggcgatgcgcaattgcttgaggccggcgttgctcagcacctcgcccaggatgttgtccagggtttccggcccgaacagggtgccgaggaaggcattcagatccttggaatactcggtcagccccaggcgggcggcaaaggccacctgacgggcgcgggcaaagccgtcgaaggcgggattgaccaggcaatcgaggatctcgcgcgcccggtcggcgcggaaattgcccatcagcaggccgtcgccatcgcgcatgccctgataggcgccgatcacggcgggcagcatgaactcgtcggtcttggcctcggcataggaggcggcgatggcggccaagggatcggccccggccacgcccttggcttccaccagggcgttccaggccagcgagacccggtcccagcgcttgtcgcggtccatagcgtaatagcggcccgagacggtggcgacggccacgtcatggcccttcacggcggccaggaagcgctccatgaagcccttggcgctgctgggcggcgtgtcgcggccgtcgaggaaggcgtggacctgaaccttgacccccgcatcggcgatggtccgcgccagggctgccagatgatcctggtgggaatgcacgccgccggggctcagcagccccatcaggtgcatggcgccgcccctggccttgaccgcggcgatggccttggccagctcgggattggcggccagggagccgtctgccacggcggcgtcgatgcgcggcaggtcctgcatcaccacccggccggcgcccagattcatgtggcccacctcggaattgcccatctggccgtcgggcagccccacctgcaagccggacgactgcagcagcgaatgggggtagctggccaggaagcggtcccagttgggagtctccgcctgggcgatggcgttgtcggcggagtcgtcacgccagccccagccgtccaggatgcacagaacgacgggacgggggcggcggggggaggcgctggacatggtctttggagcctgtggtgacgagggacggttctggcccgcaccttatccccattcaggcatttccgccagttctaggcgttgggcagcctttggcgcagcgccgccggcagcggcgccaggaccagccgtctcgcgtggtgccagaaggccgacaggctgagcaggaccgagccgatcaccagggcggtcagcgcgaaagccgcggtcgacgaacccgccgcctcgaacagggtggtggcggcgtaaagcacataggccagagccgagaccagcagggcgcggcggtccaccgccagggccaccagggccagcacggcatagatggccaccgcgccgacggcgccggcgatggtggcgcccccggcgcccagcagggagaagaccggatggacgatcatgggcgcggcggccagatgcagccagaacgccacgtccgaccgccgggtcttgcgggcgaggtcgccggcatcccagagcagcgccagggcgaacagcgccaggccggcagcgaagatcagcggcaggaagtaatcgcgcagcgccgggaccagggcgaggcccagggccagcagggctccggctccggtcacggctccggcggcgatggtgatgggaaccatgaagcgacgccaatgcgcccaggcggccaaggcggcgatggcggcggcggcggcgacgccatagccgccccgggcgaagtcatctaccccgaccacgctcaggcccgcggaaaagacgccccagacgaaggccagcagcagggccagactgggcagggccatgcggcgcttgcgagtaaagtactcggcgaaagtccaggcggcgacggccaccgaggcgccgcccagcaccggggcggccttgcccgccagccagcccagcgccgacagcagcaggatggcggcgatggtgacgaagatgtcgttgaagctggtgaccaggcggacgctctcctcgtcggcctcatgggcggtctgccgcccggcgacaaagtcccggaacgccgttgccgtctcgggcgtcaggatgccggcggcgctggccgcgtcaagatcgtcgtcgctgtacatgcctggaccacctgctgttgcgtcgcaccatagaacatggcgaaggtggtgggggcaaggatcagggatgcgcgaagggatgaatcccttcgcatccttcccccctattcccgccagcccacttcgcgggccagggcttcgagcaccgaactggacgcctcccattcctccggcggcggcgctccgtcggattgggcggcgtcccgcgccgtggcgatggtttcggccagaggcgccagaccggcggcggcgcggcggatgtcgacctcggcttcatcctcgatgggcaggggcgagagacggccgttccgccagtccagctgggtgccgtatttctggagacggccttccagcgcccggatgcggtcgtccagcatggcggcgtggcgctttggcacttcgtcgcggttggcggcggaattgagcaggccgaggcagcggcgcatgaagctggggcgcgacacggcgtgcatggccaccagccaggcggcctcggcgccatcggcggcggcggcgtcgacggtgggccagccctcgtcgtcgacgatcagttccagctcgcgggcattggattcgtgcaactggcgcagccgggcgggatagccgcccaccggctctcccgattgcagcagttcaaggcgcaacgcctgctcggcgtccttcaacgccagcaagcggtggcggaaatgtccggccaaaggcggcgctcctgataggtaagaccaatcgcttgcccaggcagatattcgatttatgtgcgcagatcaacaaattaccgggcggagcgtatgctccgcccggttaattttgcccctcaatcgccgggtgggcgcgagcgcccttggctcccgcggcataagccgcgcggccccttgggcctaaccagtctcggatcgagactggtattaatcccgggcgcccgacagcaggccgcgggcgatgacctgggcctggatctcggcggcaccctcgaagatgttgaggatgcgggcatcacagaggatgcgcgagatggggtattcctcggcatagccgttgccgccatggacctgcagcgcgttgtcggcattggcccaggcgacgcgggcggccagcagcttggccatgccggcctcgatgtcgcagcggtggccctcgtccttctcgcgggccgagaaataggtgagctggcgggcgatcatggtctccaccgccatccaggcgatcttgccgccgacgcgggggaactcatagatgggcttgccgaactggacgcgctcgttggcatacttcaggcccacttccatggcgcactgagcgacgcccacggcgcgggcggcggtctggatgcgcgccgattcgaaggtctccatcagctgcttgaagccctggccctcgacgccgcccagcaggttggctgccgggaccttgaagccgtcgaagcccagctcgtattccttcatgccgcgatagccgagaaccttgatctcgccgccggtcatgccttcggccgggaaggggttggcttcggtgccgcgcggcttgggcgcgatcatcatggacaggcccttccaatccttggtgtcgggattggtgcggaccagcagggtcatcacgtcggtgcgcgccgcgtgggtgatccaggtcttgttgccggtgaccacatattcgtcaccctgcttcaccgcacgggtgcggagcgagcccagatccgagccggtattgggctcggtgaacacggcggtgggcagaatctcgcccgaggcgatcttgggcagccattcctgcttctgctcctcggtgccgccgaggcggatcagctcgccggcgatctcggagcgggtgcccagcgagccgacgccgatatagccgcgcgacagctcctcggtgaccacgcacatggacatcttacccaggcccagcccgccgtattcctcgggcagggtcaggccgaacacgcccatctcggccacgtgattgaccacctcgatgggaatcagctcgtccttgaggtgccattcatgggcatgggggatgacctcgttctcggcgaagctgcggaactggtcgcggatgaggatcagggtctcgtcttccaggccgggctcgccgaaatggtggccatccttgatcagctcggcgatgcggctgcgcaccgccgccgtgcagccctggcggcgcagcacgttgatctccttgcaggagagcttgtggatggtgggcgaatccaggcccagatcggccagacggacgatctcgccctggctcatggggatgccgccatagatctgggcgcagtattcgccgaaggccgcctgaagcatcagggtctccagctcgcccagcttgccctcggcctccaggcgcttggcccagcccagcatctgctgcagcgccgccacataggtggccagccaggcatagccgtgggcggcggtctggttggcgtcgaacagggcgccgttgaccttgccgtccttgctcaccatggcggtgacattggccttggccgccagccgcaacgtgtcgaccacggcaattgcggactcgcaggtggggatcagatcggggagcaggatggcggtcatggcggcgtccttaaagacgattggaaatgaaaaaaaccctctcccggcgccgggagagggttttcactcaaggctcagccttcgatgcagtcttcgacggtgtagcggccgggcttgtgggcctggaccagcaccgccatgttgccgggcttgtgcaggttcttcagcatctgcatgtgggcatgcgggatgtcgttccaggcatagacctcggacatgcaggggtcgatgcggcgctcgatgaccagctggttggcctgggaggcctgcagcaggttggcgaagtggctgccctggatacgcttctggcgcatccacacgaagcgggcgtcgaaggtcaggttgtagccggtggtgccggcgcagaacaccaccatgccgccgcgcttgaccacgttgcacgacaccgggaaggtggactcgccgggatgctcgaacacgaagtcgacgtcgttgcccttgccggtgatgtcccagatggccttgccgaactcgcgggtcttcttcatgtagtcgccgaagaccttgggatcgccgtccacgtcgggcagctggccccagcaatcgaagtccttgcggttgatcacgcccttggcgcccaggcccaggacgaactcacgcttgtcttcctcggacaccacgccgatggcgttgccgcccgagacggcgatcagctggatggccatggagcccaggccgccagcggcgccccacaccaggacgttgtggccgggacgcagcacatgcgggcgatggccgaacagcatgcggtaggcggtcgccagcgtcagggtgtagcaggcgctttcttcccaggtcaggtgcttggggcgctgcatgacctgctgcgcctgcacgcggcagaactgggcgaaggagccgtcgggggtctcgtagccccagatgcgctgggtggcggagttcatcgggtcgccgccgttgcactcctcgtcgtcgccgtcggtctggttgcagtgaaccaccacctcgtcgccgaccttccagcgcttcaccttggagcccaccttgtagatgatgcccgaggcgtcggaaccggcgatgtggtaatcggccttgtgatagtcgaagggcgagatgggcttgcccaggcaggcccagacgccgttgtagttgacgccggcggccatcaccatgatcagcacttcatgcggatcgatgtcgggggtgtcgaccacctccacctgcatggcggagtcggggttgccgtgacgctcgcgccggatggcccaggcgtacatctgcttcggcacgtgtccgatcggcggaatctcacccagttcgtagagatccttgaccacctgctcgctcatcctagaactccttgaccctctggacgacacttctccgacgcggccggcctcggcgctcggtacaccgccttttagcgttttgtcgctttcttcgcaatgcacaaaatgatagtttgtttcgcgaagtcggggaaatgggaaattttaggtcgcctgcgacccctaagccctgacaaagttgcatttttttgaatggattcagtctggagcgcccgatgaccgacaagaccgcccgcgaagccgccgccccatcgcgtgagaagccctggctgttccgcacctattcaggccattcctcagcggccgaatccaacaagctgtaccggaccaacctgaccaagggtcagaccggcctgtccatcgccttcgacctgccgacccagaccggctatgacagcgaccacgtcctggccaagggcgaagtgggcaaagtgggcgttcccgtctgtcacctgggcgacatgatgacgcttttcgagggcattccgctcgaaaagatgaatacctccatgaccatcaacgccccggcggcctggctgctgtcgctgtacatcgccgcggccgagcgccagggagccaaccgttcggtgctgaacggcaccacccagaacgacgtcatcaaggaatacctgtcgcgcggcacctatatcttcgcgccgcagccctcgctgaagctgaccggcgacgtgatcgccttcacctatcgcgaggttcccaagtggaaccccatgaatgtctgctcctatcacctgcaggaagccggtgcgacgccggagcaggaattggcctacgccctggccaccgccgtggccgtgctcgacaccgtgcgccccacggtgcccgccgccgatttcgagcaggtggtcagccgcatcagcttcttcgtcaatgccggcatccgcttcgtgaccgagctgtgcaagatgcgcgccttcaccgagctgtgggacgagatctgtgtcggccgctatggcgtcaaggacgagaaggcccggcgcttccgctacggcgtccaggtcaattccctggggctgaccgagcagcagccggagaacaacgtctaccgcatcgtcatggagatgctggcggtggtgctgtccaagaacgcccgcgcccgcgccgtgcagcttcccgcctggaacgaggccctggggcttccccgtccgtgggaccagcaatggtcgctgcgcctgcagcagatcatggcctacgagaccgacctgcttgagttcggcgacatcttcgacggctcgcacgagatcacccgcaaggtggaggccctcaaggagggcgcccgcgaggaactggcgcgcatcgacgccatgggcggcgccgtctcggcggtggaatccagctatatgaagcagaagctggtggaatccaatgcgcgccgcatcggcgccatcgagaccggcgagcagatcgtggtcggcgtcaacaagtggaccgagaccgagcccagcccgctgaccaccggcgaaggctccatcatgaccgtcgatcccaaggccgaggccgagcagatcgagcgcctcaaggccttccgcgcggcccgcgacgccaaggcggtggacaaggccctggccgaactgcgctcggcggcgaacgaaggccgcaatgtgatggagccctccatcgccgccgcccatgccggcgtcaccaccggcgaatgggcccagtgcctgcgcgacgtgttcggcgaataccgcgctcccaccggcgtggcccgcgccgccgccgaggttaagggcgagaagatgggcgccgtgcgcgccaaggtcgaggcggtttcggccaagctgggccgccgggtcaagatcctggtgggcaagcccggcctggacggccattccaacggcgccgagcagatcgccgtgcgggcccgcgatgccggcatggaggtggtctacgaggggattcgcctgaccccggcccagatcgtcaacgccgccctggaagaaggcgtccacgtggtgggcctgtccatcctgtcgggcagccacgtgccgctggtcaccgaggtgctggagcgcatgaaggccgccggtctatcggacattcccgtggtggcgggcggcatcattccgcccgaggacgagaaggtgctgctggccgccggctgtgcccgcatctacacgcccaaggattacgacatcaccgccatcatgggcgacatcgtcgccctgctggatgcttcgcccaaggcggcgtgagggacgaagggcaaggtgcgaagggactcgtcccttcgcgcatcccataaataaaaggcgagggggccatccggggaaaaatggccggccccctcgccaaaagccgtcttccctgacgaggaggagactgctcttccggcaatctataccgattccaactttgccgccaaggggcggagggttgcgtttgcgtgaaggccgcccttacagaatcgccagcacgctttccggtgggcggcccagcgccgccttggtcgccgtgaccacgatggggcgctcgatgaccatgggattggcgaccatggccgcgatcagggcggaatcgtccaggctggacgggtcgacgccggcctcggcggcttccttcttgcgcaggatctcggccgggcgcttgcccagcagtcccaggatgcgggccaactcggcggccgagggcggttccttcagatagtccacgatggtcgggctgatgcccttatcctcgatcagcttcagcgtatcgcgcgacttgccgcagcgcgggttgtgatagatggtgacctgaccggacatgcctcgatcctcggagcggttaaagacgatgagtgctgttgcccataatggcgtcttgcggcgcctgttcgccaccgtgttgttgctggtctccctgggcggcggcgccctggcccagacggccgccccaccggcgcctcccccggcgttgcccgccgccgtcccggaactgcccggccagatcaacgccatcggcgacaaggccgccgacgtgatggtgcagaagatggtcgaccattcggggcgcgaccagtggggacacacggcggtcatcgtcgtcctgaccctggcggtggcgttcggcgccgaccggctgtcgcggggcgcctggcaccgtttcgccgggcggcggctgtccgacgagcagcgcctgcgcatccgccagcgcctgggctggctgcgccgcatcctgctgggcggcctgggcacggcggtcggcctgatggtggtccagtcgctgggcgtctacaatgtgctggcagtggtgggatcggaatgggggcggcgcatcctctccggcctgatcaatatcgtcctggtgctggccctggccgtggtgttctgggaggtcctgcgggccgccatcgaacgctatctgtccgccaccgattccgacggcaaccagctgcagcgctcgggccgggtgcggaccctgctgcccctggtgcgcaacgccgccttcatcatgctggtgatctcggtgggactgatcgtcctgtcggaaatcggcgtcaacatcgctccgctgctggccggcgccggtgtgctgggcatcgccatcggcttcgggtcgcaaaagctggtccaggacatcatcaccggcgccttcgtgctgttcgaggacaccatggcggtgggtgacgcggtcaaggtgggcgagcatgtggggacggtggaggccatctccatccgcgccatcaagatccgcgacggcaacggcgccttgcacaccgtgccgttcggcgccgtctccaccgtggtcaattccagccgcggcttcaattatgccgccatggacattccggtggcctatgaggtggagaccgacaaggcggcggcggtgatcaccgatctgggagccgagatgcgggccgaggccggttggggcgccatgatgatcgatcccgtcgaggtgcagggcgtcgaacgcttcgatgccgcctcggtggtgctgcgggtgcggatcaagaccacgccgggcgaccgggtcaccctgatccgcgagttcaaccgccgcctgaagcagcgcttcgacgcggcgggcatcgccatgagctcgccccaggcccagaaggtcgtgtcacactgacggcggcgcctcggcttcgaccaccgcgcgggcgatctcccaggagaagccggcgcggcccagggtggccaggtccttggcccggaactcggcccgcttgtcggcggggcgaaaggggccgaggcggcgccgccgcgccagggtgaaggcggcggccagttcggaatcgggctcctgctccgccagggcggcggcggcggtgtcggcctcgatgcccttggcggccagggtggcggaaatcagccgggcgctggcgcccttgcgccgcaagccccgcaccttgatctcggcataggcggaatcgtccagatagccgagaccggccagtttggcgatcgccgcctcgaccagggggatggcgtcctcgcgctcgccgccccaatgggccagggaacggtcaaccttgcgcatgagcacccggcgcagattggccctggacgaggaatagcgttcgagataatgcagcgctgcattctcgaggtaagatggcgtgatcctggacggggggcgcccaagggtcttgggggtgggggcagtcatggaagcgagtgtagcatgagagacgacgtcgacatccttccgcccgttccccggtcctatggagcggtcaactggctgggcacctggacccttctgatgaaggaggtgcggcgctttctcaaggtctatttccagaccatcgtcgccccggtggtcaccaccttgctgttcctctcggtgttcgccctggcgctgggaccggtggcggcccaggtcaagggcgtgcctttcgtccagttcctggcgcccggcctaatcatgatggccatcgtccagaacgccttcgccaatacctcgtcctccatcatcatcgccaaggtccagggcaatatcgtcgacatgctgatgccgccgctgaccggggccgagcagacggcggcggtggccctgggcggcgtggcccgcggcgtggcggtgggcatcgccgtcggctgttccatggcgctgttcgtgcccatgccggtgcacaatccggcgctgatcgcctatcacgccgtgatggggtcgctgatgctgtcgctgctgggcatgatgggcggcatctgggccgacaagttcgaccacatggcggcggtgaccaatttcatcgtgacgccgctgtccttcctgtcggggactttctactccatcgagcgcctgccccagaccttccacgccatcgccctggtcaatccgttcttctacatgatcgacggcttccgggcgggcttcatcggcgtcagcgacggctcggtggcggtgggggtggcggccatggcggtcgccgatctggttctgctgctgatcacctggcgcatgctcgataccgggtacaagctgaaaagctagaactcttccccgtccatggggaccaggctgaccagcttgatgtccgcattggccgcaaggatgagggtggattgatggaaccggcgggccggatttaggaaactgcgctcgccgccctcgcggtccagaacggcctgctcgtgccaaagtgtccggaacgcctgcgactgggcggccaggctttccacaagcgcctgcagcgcgggatcgcgcaggcggcggctgaaatcggcgcggaactcggccaccacccggtgggcgcgctgatcccaatcggcgatcaggcgtggggccgcgggcgagaggaagatgaagcgcagcaggttccggtcgtggtcgccgtcaagccagccggtgaaaagccgggatgcggcggaattccaggcccgcgccgtccaggtccggtcgagcagataggcggggacgttcatgtgcccgggcagcgccaacaccgccggcggtatgccgtcgtcgctggccaccggcgacacgggatcgcggcggcccgccagttcaaacagatagccccgctcggcgggagccagatgcagcgcttccgccaatcgcgccagggcatggggcgatgccgagacgtcgcgtccctgctcgagccaggtgatccaggtcaggctgacgccacaggcctcggcaagctcctcccgtcgccagccgggcgtgcgccggcggccgagggccaggggtggcggcggcagccgctcgcggtggcttctgaggaaagcgcccagggcgcggcgggggtcaacgggaagcatggtggcgaatatactaggataaaccgccatattgtaccagtgtattagccgatccaagctgtccgtcccgatgatccgaggaggtggacatgcaaagacgatcccacgatgccgttgtcagcgaccaattcagcccccagtctcaggcctatctcgccagtgcggttcacgcccggggcgaggatctggaccaactggccggcatcatcggtgaccgcccggaggcactggctctggacctgggctgtggcggcggccacgtctcctttctcctggctcctcgggtgcgtaaggttgtcgcctatgacctgtccgaggccatggtggagacggcccgcgccgaggccgcccgccgggggctcggcaatctggatgtccgccggggctcggccgagactcttccctgccccgatgccgccttcgatctggtggtcacccgccatagcgcccatcactggcacgacgtcgccaccggcctgcgggaagcccggcgcgtgctgaagccgggagggttggcggtgatcatggatgtggtgacgccgggatcggcgctgttggatacctggttgcaatccctggaactgctgcgcgatccctcccatgtgcgcaactattccgtcgaggagtggcgaaagatgctggccgtggcggggttcggcccggtgaccacctcccggttccggctgcgtctggagttttcgtcatggattcggcggatgaacacgccggaggttcatgtccaggcgatccgctccctgcagggtcgtgcgggggccgaaattgtccggcatttcgagatggaggccgacggcagctttaccctcgacaccatgctgatggcagccgaggggtgagaaaacgcgagtcgtgatgggctgaaatggcgaattcacgcccttccggttgacatttaaggttttccgaccgatattctgccgctttccatgagcgcatcggcggtttcgctcgctttcgcgaggccgccgggcattctcgggagagcgcttgtgtttccagtggtgatgccgacctatgcgcgtgccgacctcgctttcgagcggggcgaaggcgcttatctgttcacggctgatggccggcgctatctcgacttcgccgccggcgtggcggtcaatgccctgggccactgccatccccgtctggtcaaggcgctgaccgcgcaagccgccaaggtctggcacacctccaatctgtaccgggtggcgggccaggagagtgtggccgccaagctggtcgagcgcagcttcgccgacacggtgttcttctgcaattccggcgccgaggcgttggaatgcagcatcaagatggcccggcgccatcacttcgccgccggcaatccccagcgctatcgcatcatctgcgccgagggcgcctttcacggtcgcaccctggccaccgtggcggcgggcgggcagaagaagcatctggagggcttcgctccggctgtggatggtttcgaccatgtgccctacggcaatctcaacgccttgcgcgcctccatcaccgaggagaccgccgccatcctggtggagccggtccagggcgagggcggcatcgttcccggcgaccccgattacctgcggcgcctgcgcgccaccgccgatgagttcggcctgctgctgatcttcgacgaggtgcagaccggcatgggccgtaccggcaccctgtttgctcacgagcaggcgggcatcgcccccgacatcatgggcgtggccaagggtctgggcggcggcttcccggtgggcgcctgcctggccaccaccaaggccgcctcgggcatggtgcccggcactcacggctcgaccttcggcggcaatccgctggccatggcggtggccggggaagtgctggacatcatggccgagcccggcttcctggagcatgtccaggccatggccgccctgttgcggtcaaaggtcgaggataccgccgcccgcttccccggcgtggtcgaggaggtgcgcggcctcggcctgatgctgggcatcaagccccgcatgcccaataccgagatggtggcccgtctggccgagggtggcctgctgaccgtgggcgccggcgacaatatcgtgcggctgctgccgcccctgatcatcaatgacgcccaagtggacgaagcggtgggcatcctggcccgcgccttcgacgaggtgaaatgaactctgtcaatgcatccggcgccccgcgccactttctcgacctggatggatttgatacggcgacgctgcgccatatcctcgatctcggcctggcctacaagcagggcaaggggcccaaggcccccctggccggcaagatgctggccatgatcttcgagaagccctcgacgcggacccgcgtgtccttcgaggtgggcatgaagcagctgggcggcgacgtcatcatgctggcggcgggcgatacccagctcggccgcggcgagaccatcgccgataccgcccgggtgctgtcgcgcttcgtcgacgcggtgatgatccgcaccaatctgccggaaaagctcaccgagctggccaagtatgccgacgtgccggtgatcaacggcctgaccgatcagtcccatccctgccaggtgatggccgacgtcatgaccttcgaggagcatcgcggctcgctcaagggcaaggtggtggcctgggtcggcgacggcaacaacgtggccgccagctggattcacgccgccggccatttcggctgcgagatccgcttggcctgccccgacagcctgatgccgtcgcgcgccgcggtggactgggcgcgggccaagggcgccagcgtggtgctgaccacccatcccgccgaggcggtggccggcgcccatctggtgctgaccgatacctgggtgtccatgggctgccaggattccaaccgccacgagttgctggagccctatcaggtcaacgaagccctgatggccaaggcggctcccgacgccctgttcatgcattgcctgcccgcccatcgcggcgaggaggtgaccgaccccgtcatggacggaatccagtcggtggtgtgggacgaggcggaaaaccgcatgcatgtgcagaagggaatcctgacctggtgcctggcttgaccgattccgtcctgcccttctcggtgatggggggcgccgtgcgtggccgcctggcccggcttgggaccgcgctggacacggttctcgatgatcagcacggctatcctgagccggtggcggccctgctggccgacaccatggcgctggccgccgtgctggccacctccatgaagttcgacggcatcttcaccttgcaggcccagggcgacggcccggtctcgctgctggtggccgatgtgaccagcggcggcgatttgcgcgcccacgcccgcttcgacgccgcccgcctgggtcaggtgccgccgggcggacgagcttcggttcccgccatgctgggcaagggctacctcgccttcaccgtggaccaggggccggacaccgaccgctaccagggtattgtcgaactggcgggcgccaccctggaagattgcgcccgcgcctatttcaagcaatcggaacagctggacaccgccatcgaggccatggtgcgcccgccgtcgggcggacagggttgggcggcgacggcgctgatgatccagcgcatgccggccgggaccggcagtgcccccatcctggtggccgacgaggccgaggaaacttggcgtcgggccgagattctgctggccagcgtcaagggcgaggagatggtcgatcccgctctgtcgtccgagcagttgctgtatcgcctgtaccatgccgagcagcttcaggtgttcgaggccaaggagatgcgcgcccgctgccgctgctcccgcgatcgggtggaggcgaccttgcgctccctgccccccggcgaggtggcccaggtggccgacgagcagggtcagatcgtggtgacctgcgagttctgccgcaccgaccatgtcttccggctgaccgagctgcagtcgtcttgacggctcgggatgtcacgccgatattgagcccacctgtttgcaagccaagaggattcccccgatgatcgctcggcatttccgcctcgtggtggccgttgtcgccgcactcacggccagcgcctgccagaacgccaagccgcccatgcagaagctgcccgaaatcagcttcgccaacctgcggcccttccagctggacgtggggcagttggagatcgtctcggagttcgtggccaccggccgcgccccccatatcgagcacctgatgcccgtatcgcccgagggcgccgcccagcgttgggcccaggatcgcctaaagccggtgggccgtaccggcaccgctcgcgtggtcatcaaggacgccaaggtggtcgaggtgcccctggccatcgacaagggcatttccggcgccttcaagaaggagcaggaactgcgctacgaggccgccctcagcgtggcgatccagattctcgaccagcgcggcatgatccagggcgagaccatggcccaggcgtcgcggtcgcgcaccgtggccgagggcatcaccctgaacgaacgcgatcgcgtgctctacgacatcagcgaaagcctggtgaaagacatcgaccagcagatggcccaactgattcagggctatctcggccgttgggtgaggtagagtccataacgaattggatcgaatcagattccgggcttgacggggggcgttcgccaccttaaaaacgcggcttcctccgatcgaaggatcgggccaattttccacggatagccccggcgactggccgaaccggcgatccggcgaacgacttgaagcgaggattttaccatggcacgtcgctgcgccatcaccggcaagggcgttttgaccggcaacaacgtcagccacgccaacaacaagactcggcgtcggttcctgcccaacctccaggaagcctcgctgctgtccgacgccctgggtcatgcggtgcgcctgcgcatctcgaccaatggtctgaagaccatcgagcacaatggcggcatcgactcctacctgctgtccatcgccagcaccaagctgagcgccgaggcccgtcgcctgaagaagcgcatcgagcgcgctctggcgtccaagcaggacgccgtcgcggcctaaagcctcgcgtcgaagtttcctgaaagggtccgtgggcaaccgcgggcccttttggtgtttccggcgcgcttcatattcgttgatcgaataaaaagggggctggggcatcgccccaggcgggtgtaggcggcagcccgccgatgagcgatacgaaaaagcccctcccggtgttccggaaggggctttgcgccgtccgaagggacggaagactacttggtggtgccgatgccggccggggcgcgggtggtggagtagacgccgcgctggtcggggatgggcttgaacttgtccgagatgcccagcaccgtctcggcgccaccgagatagaggaagccgtcatcgggcatcacccggctcatgttgtcgagcacgcgggtcttggtgggctggtcgaaatagatcagcacgttgcggcagaacaccacgtcgaactggcccaggggcttcaggtcgtgcagcaggttgtactcgcggtactggaccatgccgcggatggccgggtcgatctgccacatctcggcggtcttcttgaagtacttgaccagcagttggatgggcaggccgcgttgcacctcgaactgggagtaaaggccggccttggccttttccagcatctcggtggagatgtcggtgccgacgatctcgatcttccagccggccagcttggcgccttcttccttcagcaccatggccagggtataggcttcctggcccgagctcgacgccgccgaccagatgcggaacgacttcttggcggcgcgggtcgccagcagatggggcagaaccacattcttgaactggtcgaacggcttgatgtcacggaagaagaacgactcgttggtcgtcatcgcctcggtgacttcgcgcagcagatcctcgccagcggtccgcagaccggaaaccagatcctccaggcccttgaggccacgcttgcgcgccacgggggtgagccggctttccagcagataggccttgtcgcgcgtaatgaccagaccggaccggtccttgagcaacttggcgacgaaatcgaaatcttcgggccgcatgggtttagcgcctcgccgccagtttcatgatccaaggagcgatttccggcagcggcaggacggccgagcagatgcccgccgtcgccgctgcccccggcatgccccacacaaccgaggaggcctcatcctgggcgataaccgtaccgccggaggcgaccaccgcctgaccacccttcatgccatcggcgcccataccggtcaggatacaggccagcacgcgcttgccataggcggcggcaatggaccgcagcatgggatcgacggccggacggcagaagttttcaggaggattcttgttcaatcgcagcaccttgtccgtacccttggtttccaccaccatgtggaagtcgcccggcgcgatatagacgcggccgccgcggatggcctcgccgtcctgggcctcgcgggcttcccagcccgaaacgcggccgatgtgctcggccaggatggtggtgaaggtggcgggcatgtgctgggtgatgacgatgggctggcggacggtgccggccttcatggtccccaacacggtgaacagggcctgaggaccgcccgtggacgagccgatggcgatgatgtccggtggctccggcgtgttgctgcgcaactggagcgggccgggcggatgaatggggaccggcgtgcgcggtgacgtcgatgcgatcaccggccgggttgccggcgggccgccggggcgggccggacgggcaccggcgcggcgggcctgacccagggcacggatcttggtcaccagttccgacttgaagtccacgccgcccgccagatcgcgggtggaggtgggcttggggatgtagtcggcggctcccatctgcatggcgcgcaacgagacgtcggcccccttgagcgtcagggtcgactgcatgatgaccttgaggccggggtcgatctgcagcagcttgggcaaagccgtcagaccatccatgaccggcatctcgatgtcgaggatgaccacgtcgatctcgttgcgctccagggaggcgagcgccatctggccattgccgaccgaggcgaccacctggataccggcctcgccttccaggatgcgggtgacgagaccgcggaccactgcggaatcgtcgaccagcatgacccggatggagtcggttgccggagaaggggaatcgatggccatgcgtttaaatcaccgaaacaggggctacagcaatccgacctgcgagaacttcgcctgaaggatttcgctgtcgaagggcttcatgatgtattcgttggcgcccgccgtaatggcttcctgaatatgctcgatatcgttttcggtggtgcagaacaccacgatgggatgctcgccgccgggaagctgccgcaaggcgcgcaggaaatcgatgccgttcatcaccggcatgttccagtcgagcagcacggcatccggcatggaccgcttgcaggcctcaagcgccgcggagccatcctcggcctcctcggtcttgaaactcaactcgtgcaggatcttcttggccaccatgcggatgaccttggaatcgtcaacgatcagacaggacttcatgcccaagcttgcctccgatggaagggcggtcttgttccccggaccgggactgccaccccttcgtggtcccttaccccatgcctatactattcgttccgcgtgaaatccagcagcttgcccacatcgagcaccaccagcagcttatcatcgagacgatagatgcctatggaaaagtctcgccaatgggggtcaagagtgggcggattacgctcgaatttggcggccggcagcgagagaacctcgcccacctggtcgaccatcaaggagtaaagctcgccgcccatgtcgacgacgacgctcatgcccttcttgtcctcggcccgcttcttgaggccgaggcgcaggcgcacgtcgatggcggtgacgatgcggccgcgcaggttcagcgagccggcgacctcgcgcggggccaggggaatgcgggtgatcttctgcggacccagcacatcctgcaccgtcagcaccggaatgccgaacagctggccttcgatgaacatggtcacgaagtcctgggtctcgggagcggccagctccgttccagggcgcttaccagcgggaactaactgattcacttcgtggcccccctattcaagggttggagcattgcgacgcggcgggtgcgaagggtggtcatgcggcacctttggaggctgcgatggtagaggccagggtctgcaacagcgcatcacggtcgaacttggcgatgtagtcgttgaaaccgacctgacggccgcgctcgaagtccttttccgtggcgtgtgacgacagggccaccatggggattgtgccccagcggccgtcggcgcgcaccgccgcggcgaactcgaatccgctcatgcccggcatctcgatgtcgctgatgatggcgtcgaactcgtcgccgcgctcgcgcagttgcagggccttgtcggcaccatccaccgagatgacctcgtagccggccaccgacagcaggggcgtcagcagattgcggaagaacggcgagtcgtccaccagcaggacgcgcggcgcatggaagtcggcattgccgaattccttgtcgttgcggccgaaccagtcgccgaacgcctgcggcaggtaatagccggcatcgatgatggtggtggccttgccggcgatgaccgcggtgccgatgacaccgggattgtcggccgacagctccaccttgagacggtcctcgacgatgtcgacgatctcgtcgaccaccaggcccatggtgtggtccttgtcggagaacaccagcaccggctggcggccttcgtcgcggaaattcatgatgccgtcgatggcgatcagcggcatcagatggccacggtactggaccatgggcttgccatggctgtgctcgatctcgccgacctcgatctcttcgagacgggcgaccagcgccaagggcaccgccttgaggtcgtcgccgccggcacggaacaccagcagcgaggtcttgaggtcggcgtggctctcgcgcaccgtctgggcctcggcgtcgcgggtgccgccggccatcatgcccgattcgccggtggcgccggcgatgccgttgggatcgaggatcatgatcaccgaaccgtcgcccaggatggtgttgcccgagaacatggagatgtggcgcaggatcggcgccaccggcttgaccacgatttcctcggtgtcgaacacccggtcgacgatgatgccgaaggtgtaggtgcccacctgggtgacgacgatgaaggtttcctgctgttcctcgtcgttctcggccagcttgagcaggcgcttgagcgagaccagcggcaggagacggtcacgcaggcgcagcaccggcgcgttgttgatcatctcgatgccgtgctcggaattggcggtgactcgcaccagttccagaacgctgatctgcggaatggcaaagcgctcgaccgcgcattcgacgatcagggccgagacgatggccagcgtcagcgggatcttgatgatgaaggaggagcccttgccgggctggctcttcagctcgacggtgccgccgatcttctcgatgttggtgcgcaccacgtccatgccgacgccgcggcccgagacgctggtgaccttctcggcggtggagaagccggccttgaagataaactggtagatctgctgcggcgtcagcgcttccagctcggactcggtggcgagaccgttctggatggctttctgcttgatgcggtccaggttgaggccgcggccgtcgtcggaaatctcgatgatgatgtggccgccctcgtggaaggcgttcagcacgatcttgccgatttccggcttgcccacgcgcttgcgctcttcggtgccttccaggccgtgatcggccgagttgcgcaccatgtgggtcagcgggtccttgatcagctccagaacctgacggtccagttcggtttcggcgccgagcatctggaggtcgatcttcttgttcatttcgaccgcgaggtcgcggacgatgcgcggcagcttggcccaggcgttgccgatgggctgcatgcgggtcttcatcacaccttcctgaaggtcggtggtgatgtgggacaggcgttgcagcggggttgcgaattcgctgtcgtccttgccgcggaccatctggagcaactggttgcgagtcagcaccagttcggacaccagggtcatcaggttttccagcaattccacgttgacgcggatggtctgggcggcgacggcggattccttggcctcgccggcgggaaccggcggagcggccgcggcggcgggaggcgatggctgcggcgtggtggcggggacgctggccttgaccggctcgggttcgggctcgggctcaggctcgggagcggcggccacgggctccggcgcgggagcggcggccacgggctcgaaaaccggcatgggcggcgagggcggcggcggcgcggacggggcgccgatggcgcggccctcggccatggcattcaggcgttcgatcaggtcctcgtcgctgccctcgggctcgcactcgttctgctccaggtggcccaggatcagcttgatgcggtcgatggactgaaggatcagggtcacggcatcgggcgtgacttccagttcgccgtcgcggaacttgccgagcacattctcgcccgcatgggccacatgctcaaggcgcggcagcccaagaaagccgcaggtgcccttgatggtgtgaaccagacggaagatgttgcccagaatctgcgggtcgttggggttttgctccagattcaccagggcaatgtcaagaacggaaagactttccgatgtctcagtcagaaattcactgaggagatcgtccatgatcgactccagtacggtcctgtttcagcacgcgcaggcagcactaaaactacctctccccctatccgaaccggacaggccatgtcgactaatagcacggcgagagggtctttagaagaaccctgaccagggtaaatccgcttgcgtaacgattttttccacaatgtccgtcaggccatgatcgaaatctcccccgccccgggtgtgaggcggattttcaagccattacggtgggcaaggtgcaaggcgaaccccgcctgggctccccgcggacccgagggtggggcgccatcgagcagcaccagtcgggcctcggcggtcaggcccatcccctcgccgctggcggtgacccgcagtccggcctcgccgtcgctgccgctgccggcacaccgggcaagaatcttgcccccgcgtggcaaggcgtcgcgggcgatgagcaccagattgagccgcagacgccccgtctcaccgtcgatttccggccgctcgctggaccagtcgagggtaatgccgccggtgaccgcgccactgagataggcgcgcatcaggtcgcccagggacttctgggtatggggcatgtcgttggcgggtcccagggtggcgcgcaggaatttcaggcgtgccgtcgccgcacccatgctggccgaaaccagctccagcgtctccgggtcgttgccgtcctccagtaattccagcccggccgccgccgcccccagcgggctggccagatcgtggcacaggcgggcgcagagaagttccgagaatttcgtgtcgagggccgagctcatgggtaggagtatccgggatttcacctatgatacataatcataccatgggtacagtcaataggtcatagacaaagggtcgccacggcttccaggtgggcggaccacggaaactggtcgattggcacgacgcgcttgatgcgccagccgccatcgcacagggtgcgaaggtcgcgggccagggtcgcggggttgcacgacaccatggcgatggtggtcggcccacccggactagggcgggccagttcggcggcctgggcggcggctccggcccggggcgggtcgaggacgatggcccggaagcccttcagctcgtgggccgccagggggcgccgggccagatcgcggacctcggcggtaagcggcaagctcgccgcccgggcggcggcttccagggccgccaccggcccctgttcgccctccaccgcccgcacggggccgcgcagagccagcggcaggctgaagctgccgcagccggaatagagatcggccaccggcacatccttaggcgtggccgacagaatggcttcggcgatggccagttcgccgccgcgggtcggctggaggaagccgccgggggccggttcgacggcaattccgccgaaatgcaccagggccgcccggcgtcgggcgatgggctccacgaggccagtgccggggcgtcgccagtgcaggcgggcgaggtcgaggctggcggcggcctccgccaaggtctcgcgctcgaacaggtcgaggcgagccggagcctccaccagaacgtccagcccaccctcggtcagggtgagggtgagatcgccgccgccttcgatggcgatgccacccagcagcttgcgcaggccgggaagggcgtcgcccagggcggggtccagcagcgggcagcgttcgatgtcgacgacggtgtggctggctcggccgttgaatcccagaacgatggcgcccttggcccgggtgaaggcgaaggtggcccgacgccgcgaggcgggcggaatccgcaccaacggctcgacgatggcttcggccaggccttgccgcgccagctgggtgaccagcaggtcgcgcttccattcggcgtaaagggcatcgtccagatgctgcagcgagcagccgccgcagcggccgtaatgggcgcagggcggcgtggcccgtccggggccgggctccagcacctcgatcagggcggcggtcaggccgtcgccccgcttgccttcgacgcgggccagaacccggtcgccagccacggtgaagggaacgaagaccgtttcgccgtccaggcgggcgatcccgtcgccgcgtgctcccacctggtccacggtcagttcgacggtgcgggatggagccgggttgcgagcggggcgcggcggcgcgcggcggggctttctcatggtgtctggcggcccagatcggccaggaagcggccgaagatgtcggcgacgcccttctccatggccagcgccgcatcctcgacccgggccgaggacacgggcacgcgggcggtataggtctccagcagcaccagccgcccgtcgcgggcccggaccacggccagttccaggtcgaccaccgcttcggcgcggtcggcgatctgttcgaagcgccgcaccttgccgcgcagcacccagtcggccaggacgcgaagctcgggcgtcaccaccttgtcggcgattccggcggcggcgaggtaatgggcgaggcgatcctgcagcaacaggccgggcggctcgctccagaaatcatacttgtaatgggccagggcgccgccctcggtccgcgagaaggccaaagcccgctcggccgccaccccgtccgaggccaggcggttgatctccagcacgccgggcaggaccggcctgggcagccgctgggcgggtgccgccacttcgatgcggtagaacgaatcgggcggcgccgctggcccggcgcaggcggcgagagcgagaagcgatgccgcggcgagtaccttgcgcatgaccatgcctttatttccgtcccgggccgtcttcgccccgcttgttgccgccgatcagcacgccgggattgtcgcggatctggcgcgagaattcgtgcaggttccgggtggtgccgtccagattataggtgaccgaatcgatggagcgcgacaccgcctgcagggtgtggcgcaggtccttcaggctctggtcgatgttgtcctggttgccggtgatggacttgtccagcgaggtcagcatggaatcgaccttcttgcggctgtcctgcagcccggccgacagcctggcggcattgtccagggtctcgcggatgcgctcggcattggcgtcggtgaccaccttgttggacagggtgccggtcatcttctccacgtcggcggtgatcttcggcgtcttggcggccagatcctgggtgaccagcagcaggttggccatcagctcgggggcgtgcttttccaagatggtgcccaggctgcccacctgctggttcaggctgaacagcagcggcttcagggcggtctggttcaaatcggtgatctggcccgccatgtcgttcatggcggcgaagatgttggcggcggggccggaggggatgtccgagccggggggcagcatctcgggcgacgtaccgcccttgatgtccagggtggcggccgccagcaggccggacgcggcgacgcgggcctgggaatccttggggatgcgccagtcgttggccaccgagatctccaggcggaaggcggtggcgttgccctcgtgcagcggctggatcttctccacctgtcccacggggaagccttcgaaggtgaccttggtcccgtacttgatgccggccacgttggacagccgggtgtagtaggatccggtggcgccggtccggccggtcaacaccaccaccaccaccaccagcgacaccagcatggccagcacgaagccgcccaccatcgcgtagttgatacgggaatccttcatgggctgcgggtccggtcagtggagtgggcgtggccgccggtcagtcggcgcagataggactcggcgtcgggctcggcttcctcggtgcggcggttcagcaggttctggatgcgcgggtcgcggctggcgcggatggcgtccacggtgtccagggccaggacgtgccccttgtccagcacgcagatgcggtcggcgatcttgaaggtggaatccaggtcatgggtgaccaccacgatgctcatgcccatggcgtcccgcaggcgcaggatcaggtcgtcgatggacgacgccaccaccgggtccagcccggccgagggttcgtcgcagaacagcagttccgggtccatgacgatggcgcgggccagggcggcgcgcttgatcatgccgcccgacagctcggcgggcttgaggtgctcgaacccggccaggctcaccacttccagcttgagccgcgtcatgatgccgatggtggtctcgtccagctcggtatgctcgcgcagcggcagggcgatgttgtcgccgacggtcatggaactgaacagggcccccgactggaacgccacgccggtacgggtgcgcaggcgctgcagcgcgatgggcgacagccgggcgatgtcgtggcccaggatgcgcaccgtgccggcgctgggcttcttcaagcccagcagatggctgagcagggtcgtcttgcccgagcccgagccccccatgatcaccatgatctcgccgcgtgccacattgagcgagacgtcgtgcagaatctggcggctgccgtaatgggcgaccagattgctgacttcgatgctgttacccggcccggccatcagcgcgtcaccatgaagacgaagatcatgtcggtgatgacgatggccgagatggcgtggaccaccgagcgggtggtcatgcggccgaccccttcggcgccgccggttaccgaggcgccgttgaccacgcccaccacggtgatcagtaccgagaagatggcgcttttccccaggccatgccagatgtcgttgagcctgaccagatcggtcatctcgtccacataggcgcccatggagctgcccagttgcggcgcgatgtagaggccggcggcgaacagccccaccagatcggaccacagggtcagggcgggcagcatcgccatcatggccagcagcggcggcaccaccaggaagcgcaccggcgagactcccatgacggtcagcgcgtcgatctcctggttgatgcgcatggtgcccaggcgggcggccagagccgagcccgagcgccccgccaccaggatgccggtgatcagcggtccgaactcgcgcaccaccgacatggcgacgcccagcgacacccgggattcggcgccgaacaggcgcagcgtgtagatgccctgaatggccagcatgatgccgatggtggccgacagcacggtgacgatgggcagcgcgccgatgccgatctccatggcctgggccaccacgggggccaggcgcaccggctggcggcgcttgccgcccatgcccagccagtaaaggctttcgcccagcagggaggcgccgaatccgaactcgacgattccggccacggcccggcggcccagccggtcgagaaatccgatgaatcccctgggttcggcctcggaggtcacccggtcatccccccagggcgtcttcgatcgtcgccgcgatggtgaaaacccggtccaggcgggccagctgcagcacccggcggaccggatcgctgatggcgaccaggacgaagagggtcccgttcttgcgggccatctggtaggcctcgaccagtccggcgatgcccgagctgtcgatgtattccacccgcgacagatcgacggcgacggggcgcttttccagcatcaactccatcaacgtcttgcgcagattgggggagtggcgcagatccacttcgcccgacagagagatgacggtggcgttttccgcggcgcgggtctcaatcttcatgtcgggtcgatccgtttcaccatttgcagcagattgccgattccggccggtggcggcagaaattcgacgctgtccatgaccgagcgtatcagatgggttcccaatcccccgggccgcacctcgtccagcggcctcggctcgattttagccacatccactgcgggagcgaaatccataagtcgtatgacgagtcgattaggctcgcgatcaaggtgaacgatgatctcgccttctccgcctttgtaggcgtggcggatgatgttctgacaggcttcgtccacggccagcaccacgtcacccaccacggcctcgccgcagccctggccgcgcatggcgttgcccagggcggacctgatcgccgacagctcctcggcccgggccgggtagcggccttcaaagcccaggccaaggcggcggcggtcctcgatcaccatcagggtgacgtcgtcgcgcaggccgccgctgtcttccagggaccgcaccatggccttgaggcgctcgcccgccggcatgggggcgaagctggcgatcagcgcccgggcgccggcgtcctccagcatggcgtcgtgctgggtgcgggcctcggtcagtccgtcggtgaagaggtaaagcgagccgccgtccaggttgaactccacctcgggacagccatcggcgaacagttcgacggcgatgcccagcggcggcatctcgccctcgatggcggtgaagactccgttcttcagcaacagcggctgctcgtgcccggcgatggccagcacgccccgccccgacgccgggtcgaacaggccggcgaccatggtgacgaacatgccgggcatgcgggtctccagcaattcggcattgatggcggccaggaccggccctggtccggcctctcgcttggcgaggcagcggaacaggctggcggtcttggacatcagcagcgacgccttcatgcccttgcccgagacgtcgccgatggcgaaagccagccgaccgtcggccaggggcatgatctcgaagaaatcgccggaaacgccgctggccggcagattgatgccgtggatgggcgattgctcgggctgttgtcccggcagcatggcgcgctggatctccgaagccagttcaagctcgcgcttcaggctctgctgttccgccatgtcggccaccagccgggcgttgatcagggccagggcggaactggcggccagggcctgcagcaggcgggaatccgtcagggaaaaggcgttgccgtccgtcttgttgaacagttcgatggcccccagacgggtgccgcgcaccatcatgggcgcgcacaggatggaccgggtctcgaatccggtggcggcatcgatggcctgggcgaaatccgggtcgcgccgggtgtccttcaccagttgcggcgcgcccaggtcgatggtgcgcccgacgattcccgtgccggggggcaggcgcaggccgaccacgtccaccggccccacattggcgcggcagaccaggtcgccggtgtcgtcgtcgatgaggaacagcgaggcggcttgcgcccccacccgctgggcgatgcgttccaggcccagtcgaagcgtggcttccacatcctgggaatgggcgaagtcaccggtcatctcgacgatcaggtcgaggtggctggcggaatcggctgaggcgtgcaaactggacatgcctcatcatgccaagctcggctgaaaccgccaaatggttagatttagagtctatagatataaaaaaaatgcatccggggctcgactttttgcgctccgcccgtgtaaagggggggagggacgggggaaggtcgtgttggggctgacgatgttgttttcacgaggcaagggcggtcctgggatcgaacccggcgatgttttccataagcttggaacctatggcagcgactggacggtggagcggatcttcgattacgccgacattccccgccatgtccgtctgatcgaccgcaacagcggccgcaccatgacggtggcggcggccatgctgctcgaccccgacaatttcgttcggcgcaccgcctgaggcggccagatcacggtggacggcagtccaggctgccggccagatgcttttcgatcagcggcggatagtcgtagatcagggagctttcccgctggtgcacggcgacctcggtctcgccgcccttgcggatgaaatccaccaccaggaaggtctcggtgcggaacaccgcctccaactcgccgaccagttcggcgcggttgccgttgagcgaggtgttgcagcggtaatggtaattggggccacgcgcacaccaggacagcatcctggccaccttggggcaggcattggccggcgtgagcgcggtccgcaggctgacgcgcttgtcggcattggcccgcgcctcctcggcggtgcggtcgggcgtgatcagggaacatccccccagggccaatagcgacgcgaggatggcgggaattctcatgggtcttccgatacgggttcgcaaaaatcctacctgggtttgcatgggaacggaactagggttttcaccctaggactcctggatggctcccagcatggcggccaccgcgttggtcagacggattaggtcgccgtcgcgtgacaggcggtggtcgccgtccttgaccagggtgacgtccacccgctccgaggccaggcaatcggccaggcggatcgccgtctgccacggcacgtcctcgtccttctggccctgaatcaaccggacggggcaatgaatctggatcaggtcgcgcagcagcaggtggttgcggccgtcctcgatcagcgagcgatggatgtgccagggattgtcgggctcgtagcaattgggcaattccaattgcccggtttccatcagggtacggcgctgttcgaaggtgaagtcctgccacatcaggtcttcggtgaagtcgggggcggcggcgacgccgaccaggccggccaccttgtcgcgcagttccagcgcggccagcagggcgatccagccccccaggctggaacccaccaggacctgcggcccttgggtaagctccccgatgactgccacggcatcggcggcccagcgcccgacggtgccgtaaaggacgtcgcccgaggatcggccgtggccgaaatagtcgaagcgcaggaaggcgcggcgctgcgcccggcacatttcctccagggccagcgccttggtaccctccatgtcggaatgatagccgtgcaggaagacgacgccgggagtcttgccttccagcctgtggtaagcgattgtcgcgccgtcggggcgtgttagtatcccgcccccttcggaaagttgcccgctttcagagttctcagtcatcgctgttcggaaacccatggatcacgtcccccccatcgaagcgccttccgcgaccattcgtcaaccggtcgtgttgcaggtgctgcccgcgctggtcaccggcggtgtcgagcgcggaaccgtcgacatggccgtcgccctggccgaggcgggatggaaggccatggtcgcttcggagggcggccccatggtgcgcgagttgacccgcgccggggccgagcacatcaccttgccgctggcgtccaagaacccgctgaccatccgggccaatgccctgaagctggccgatatcatcgccgccaacggcgtggacatcgtccacgcccgctcgcgcgcgccggcctggagcgcatggatcgccgcccaggccaccggcgcccattatgtcaccaccttccacgggacctacaatctcggctggttcggactgaagcagaagtacaacgccgtgatgacccggggcgagaaggtgatcgccatttcggacttcatcgccgagcacgcccggcggatctacggcctggaggccgagcgggtccgcgtggttcatcgcggcatcgacatgacgcgtttcgatcccacccgcgtcagtcccgagcgcatcatccagctggcccagaagtggcggctgcccgatggctaccaggtcatcatgctgcccggccgcctgacccgctggaaggggcaggccgtgctgatcgaggccctggcattgctgggccgtcacgacgtgcgctgcctgctggtgggctcggatcagggccgtaccggctaccgcgaggaactggtcgagctgatcaagcgccgcgacctcaccgacgtggtccatctggccgacgagtgcagcgacatgcccgccgcctacatgctgaccgacgtggtggtctcggcctccaccgacccggaagcgttcggccgcgtggcggtggaggggcaggccatgggccgcccggtgatcgccaccgcccatggcgctaccaacgagacggtactgcccggccgcaccggctggttgaccgcgccgggcgacccggaagctctggcgcaggcgctggaccgctttctggcgctttctggggaggaacgagacctgatggccaaggacgccatggatttcgtacgcgccaagttctccaaggagagcatgtgcgccagcaccctcgatgtctatcgcgaggtgctgggccttgccctggccgctccgcaggcggagtgatggcggcaagccggattcttgtgatcaagctcggcgccctgggcgatttcgtccaggcgatggggccgttcgccgccatccgcgcccggcatgccgatgcccacatcaccttgttgaccacccggccctttgccgaactggcgcaggcgtgcccgtggttcgacgaggtctggctggacgacaagccgcccctgtggcgcctcgacaaggtgctggccttggccgcccgactgcggggcggccgcttcgagcgggtctacgacctgcagacgtcggaccgctcgtcctggtatttcaggttgatggacaaaggggtggaatggtctgggatcgcccagggctgctcccatccccacgccaatccccggcgagatttcatgcacaccatcgagcgccagcgcgagcagttgggcatggcgggtattgccaaggtgcctccgcctgacctggcctgggccgaggcggtgccggggcgcttcgacattcccgggcgcttcgtgctgctggtccccggcggcgcgccgcaccgtccggccaagcgctggccggcggagcgcttcggccgtctggcggtctggctggtggcgcggggcctcaccccagtcctgctgggcactcataaggagcgggccgagatcgaggtcatcacgaccgcctgtccccaggcgatggatctgtcggaaaagaccggctttcccgacatcatcgccctgtcgcgccgagccgaggcggccttgggcaacgacaccggtcccatgcacctgatcgccgctggcggctgcccgtcggtggtgctgttctcccacgaatccgaccccaacctgtgtgccccgcgcggcaatgtgaccgtgctgcgccgtccgtctctggccgagctgggcgagacggaggtcgaagccgctttggacggcatgctgcccacggcttgactcgagcgcgtttgtccttagactccctccccctgatttgttcccacgcgtgaaagagagtgtcatggtcgccatcaccctgcccgacggcaaggtccgccaattcgatcacccggtgacgggtctggacgtggccaaggatatcggccccggtctggccaaggcggcgctggccatcactatcgatggtgagatgaaggatctcgccacgctgatcgatcgcgacgtgaacctctccatcatcaccgccaagagcggccaggacgcgctggaattgctgcgccacgacgccgcccacgtcatggccgaggcggtgaaggagctgtatcccgagacccaggtgaccatcggtccctccatcgaaaacggcttctattacgacttcgcccgcccgacccccttcacgcccgacgatctggccaagatcgaggcgcgcatggccgaaatcgtcgaccgcgacgaggccattactcgcgaggaatgggaccgcgacgcggcggtgaagttcttcgaagacgccggcgagaagtacaaggcggagatcatcgcctcgatccccgccgaccagaagatcggcctctatcgccagggcaatttcatcgatctgtgccgcggcccccatctgccgtccaccgccaagctgggcaaggccttcaagctgatgaagctggccggcgcctattggcgcggcgattcccgcaacgagatgctgcagcgcatctacggcaccgcctggttcgacaagaaggaactggacgcctatctccacatgctggaagaggcggaaaagcgcgaccaccgccgcctgggccgcgagatggagctgttccaccagcaggaagaggccgccgggtcggtgttctggcacaagaagggctggacgctgtatcgcgccgtcgagtcctatatgcgccgccgcctggaagccaacaattacgaggaagtgaagacgccgcagctggtggacttctccttgtgggaggcctcgggccacgccgacaagttctccgagtccatgttcaccatcaagacccaggacgagcgccacctggcggtgaagcccatgaactgtccctgccacgtgcagatcttccgccagggcatcaagagctatcgcgacttgccgctgcgcatggccgagttcggctcgtgccatcgctacgagccgtcgggcgcgctgcacggcatcatgcgggtgcgcgccttcacccaggacgacgcccacatcttctgcaccgaggaccagatcacctcggagaccatcgccttctgccagttgctgaaggaggtctacaccgatttcggcttcaccgatgtgcgggtcaagttctcggaccgcccggccaagcgcgccggctcggacgagacctgggacaaggcggaaagcgccctgctggaggcctccaaggccgccgggctggagaccgtgctcaatccgggcgaaggcgccttctacggccccaagctggaattcgtgctgcgcgacgccatcggccgcgactggcagtgcggcacgctgcaggtggacttcgtgctgccagagcgcctggacgccgcctatgtggccgaagacggcgccaagaagcgtcccgtcatgctgcaccgggccatcctgggctcgttcgagcgcttcctcggcatcctgatcgagaacttcgccgggcgtttccccctgtggctggcccccacccaggtggtggtcgccaccatcgtgtcggaggccgacgacttcgcccgcgaagtcgaggctacattgaaggccgccggtctgcgggtcgagttggacttgcgcaacgaaaagatcaactacaaggtccgtgaacattccgtcgccaaggtgccggtgatgctggtggtcggcaagcgcgaggcggagagccgtcaggtcgccatccgccgtctgggcagccaaaaccaagaaattgttgcgctggaccaagcagtcgctacacttgccgcagaggcgaccccgcccgcgtgacggagggcgccccttgggaccgatggcctggcccgcgataaccgcgcccgggcactaggtgtactcgaaacgatggagattgttctatagctaggcccccgatgcagacgccgcccaagaacgacgggccgcgcgtcaaccgcgagatcgatgtgcgttccatccgcctggtgggcgccgacggagaaatgatcggagtcgtgaccctgcgcgagggtctggtgatggccgaggaagccgggctcgacctggtcgaggtctcgcccaacgccgatccgccggtctgcaagattctggacttcggaaagttcaaatacgaagaccagaagaagaagaacgccgcccgcaagaagcagaaggtgatcgaggtcaaggaggtcaagctccgcccgaacatcgacgaccatgactatgacgtcaagatgcgcagcatgcggaaattcctcgaggaaggcgacaaggtgaaggtcaccctgcgcttccgtggtcgcgaactggctcaccaggacctgggcatgaaggtgctggagcgggtgcgcgacgatctcgaagatctgggcaaggtcgagcagattcccaagatggaaggccgtcagatggtcatggtgatctcggcgaagtaggattcgccggggttcccaactttatttccgcacccgcgtaaagcgggttgcggagctgaaggctttacgctattttccgcgcctccccaccgacccggggatcagcgaccctgtggaggggtggcagagtggtcgaatgcgccggtctcgaaaaccggtatgggtgcaagctcatcgtgggttcgaatcccaccccctccgccattacttccaaagaatagattctctgacacatagagccttgggcgaaagcccaaggctctgcgccgtttttggccagtagctgttgaccttctggtcttgtgacggcgcatttttaaccaattttctcttctctcccgccctgtttctctggaagctgttgactgccgccaaacggtacgggttttaaagttgcaagtaattcaaagagttgcgatgccaaaagctgttgaccatttcgctatttttattggtgcgggctggagtctggggttggattcggcggtcaacagccatcttggagccccgcagtgtcgcacggccccaagggggcttgcgcgccaatctcccgtgccgtgcctggatcggctctgctactgttcccctcatggataccaccatcgccaccattaccgtgcagcgcatcaccccgatcaagaatgccggcaagcttctcgccctggctgatgtggagaccgtcatagatggcgtggccctcgtcatccacggggttcaggtgagagccgatggcgacaagacggaaattgccttgccgcgctaccgtgcgcccaatggcgaatggcagacggcgatcacccttccggaggaagtgcgagagcctatggccaatgtcgtgatcgccggcgccattgaaataggcctgttgaaacagcggtagacgaggccatgaggtgcggttgttgggcgcagagaatcaagcgccgtgctcttaccactctcatcaccgccggtcccattctaccggcagatcatcgcctttacgccgcgcgggcgagacgctgcctgacttccttgacgagggtccgcacatgatcgacggaaaggcgatcccgcagcagaaaggcatgcatggttggatcgtcgaggagatcgtccagcgacggctcccatatccaccgatcaagcccgaagtcttgcgcccgcatttgcccctcccaaggtctgctattctcgacgacgcctgatgtctacactgcatccgcccgctcgtccgtgaacaattgcatacaacgaccacccagccggcaaaggcaggatggccaatcacaattcagttttcggccttcggcacggaccccagacgctgcagaaactcaggctcgtcataatcgcccatttcagggtcggcggtctgacggacgacatccacgccggctacgctgccaccctccatcatgcggctggcacgttgcagggcctgtggctcggtcttgtaggaaatgggcggctgaggcttcagcccgcctcttttgccgaggatgtatggctggcagatgaacaaggtttcgagggccatggcgtgattcctgcggcaagggcgattgccacagagtgttttctttttgttcttttgtcaatatgcatggtcgcatcggggattcgcgccctcggtcaccgcgtcgccatcccgtacctttcccgctgctggtcccattccaccggcatgtcgtccatcaggtcggcaagatggagggtgcgcggctggcgaccgtcgaggatggtctcgacaatgtcgggggccagcaaggtcagtcggtagatgcgggtcagatacgacggattgatcttctcggcttcggacaactcgttcagggatgccacctgcccggattccagcatgcgcttccagcgatgggcacgggccagcgccttcagcagcgtgtcgtcgggggtgggtttggcgcgtaccggtacgccctcgccctccggcacgatcaccagcttgcggccaccatatcgccgcagggtcagcggcacgcggatggtcagggtgtcgatccggatgttcgcggtcatgccgcgctcctatcgccggtctgggcggtgatgtcggcgatgacgctggccagtccctcggcccgcaaccggacctcggcgccgtctggggcgatggccactttctcgaccagaagctggaggatacgggcctgctcggcggggaacagttcgtcccagagtgcctcgaagcgatcgagggcggcgtgcagatcggccggcgacatggttggcgccatccgttcggcccgcgcccggatctcgggggcgcgcagcaatgcccggacctgtccgatgacggccgcctcaatctcaccggcggcgatgctgcgcaccgggcaggactcgtggccggaatggatggccttcatgcaggtatagtagcggtacagccgtcctttcttgcgggtgtgtgagggcgtcatggcccggccgcaatgggcgcagtgaatcagccccttcagcggtgccggagtcgaggatcgcaccgcattggcccgtttcctgggggcgttgtcggtcttgaccgccaccaccttgtcccaggtggcgcggtcgatgatggcgggatgctctccggcatgggcctcgcccttgtggacggcctcaccgagatagacccggttatcgagcaacttgtagaggaagttcttggtgatgggcgcgccgtcgcggatcttgccgtcctgggtggtccaggacttggtatggtgaccggcggcgttcagttccttgaccagcaaggtggcagagccaaccttgagaaagcgttcgaagatgtggcggaccagatcggcctcgggctggttgaccaccagcttgcgggcgaccacgtcgtagcccaagggtggcactccgcccatccacatgcccttgcgccgggaggcggcgaatttgtcgcggatgcgctcgccgatcacttcccgctcgaactgggcgaagctgagcaggatgttgagcgtcaaccggcccatggaggtggtggtgttgaacgactgggtcaccgagacgaaggtgacggcgttgcggtcgaacacctcgaccagtttggagaaatccatcagcgagcgcgacagacggtcgatcttgtagaccaccaccacatcgatcagcccggactcgatgtcggccagcaggcgcttcagagcaggacgttccaagttgccgcctgagaagccgccatcatcgtagtggtccggcaccggcacccagccctcggccttctggctggtgatgtaggcttcgcaggattcccgctgggcgtcgaggctattgaattccatctccagcccctcttccgaagacttgcgagtatagatggcgcagcggaccttgcggatcggggtcatcggttgccctccagcttgccgtgtttccgaaggccgaaaaagagagggccattccaccgggtgccggtgattgcgcgggccaccgccgacaggctctggtagcgccgcccctgccactcgaagccgtcggccagggcggtcacctcctgcagcacgccttgccattcccggatcagcttggtgccaacgatgggggcagtcatgtccttgggtttcggcttcctcttgccgtccagctcatcgaccagatcgtcgatgcggcgttcggcctggaccgacaggccgccgaaggccagttcctgaatccggtaggcgaggcgcttgaccaggaaggtgcggttgtagggcggcggctcggtgccggtcagttcccgccacatgaccttcagcctgggcgtcggcagggtgggcaattcggccacctgggtaagaattgaggttgtcatttacggggtctcctgcaattgcggtcagacccatggacgctctggtggccagtgaagtcgacggaacagtctccggcgtcagcagataaacgagtggactttcgcgccatcaggcgcatggccccgaccgccagaatctcggcgatttcgtcgaggcgttcggcggcggtcatgtggtcggggtggagggcaagggacatgggaggaaacctgattgtggtgcctatgactccctgtaccggagcaacctccattccgtcccaagagggggctatgccgctccccgaccgaccagccccaacgccttccacaacttggaaaccttctttttgaccgtactctcgtcaggcacggcggcgcacttgtcatcaaaccagccgagcagatcacggaccatcgccgcctgggtaggcggaatgccatcatcatggatacgtcggcaggcttcgacccagaagccatcccaatcatatttgggcggggcaccggggccgccacgcacgacaggcgggttggaggcagagatatccggaggtgcgggtgtgctattggcctcgaatcgctcgacctcgtcacgccggatcaggatgtcgtctgcggcagcggagaagtccgattggcgagcctctggttcgaggtcgatgtagccatcattctcgccagcaagatcggtgatgatcccggtgtgatttttgataagcccccatgcatcacggggatagagatcaaaaatccccatgacacgccgccgatccgcagggatgcgttgccagttttcatcaccgaagtcttcgtaatgcccgatttcggcgaaaacccccggcactggaatggataacctgagcttgccttcgagggcgacggcagcgatctgggtgggcttcacatgccagcgctcacacaggtcggccagcgtcagataggtgactggagaaggggccatgatcatcagcctccctcgacggcgcgcaggcggcggtaggcgcgcaccaccttggcgacatcgcgctgcatgtcgggcgggaatcgctcggcggcgacaaacaggtcatcgagacgaacccccagcacggcagcggccttctcgatcaaatcgtcgcggggcggcttttcgcattcccgttcaatgcgcgaccaataggcgggggaaaccccgaggcggctggcgaaatcattgagcccaatgcccaattcattgcggcggacgcggatataggatccgaacggcatcatgccctcccctggccggtgacgagacggtacttgcgcaggcggacccagatgaaggatggggacaccccaaagattccagcgagatcgtcgagcagcacatcctgctcgcccatgccccaccgccgtccatcaatcaccgggtagccgggtttgccggcatggtcggagccgttgaccagggtgacgccgaattcaccggcgcgcctcaccatggtgcgatgaagcaagtctggcggcgccagcaatccacccatgaactcgttggcccggtactccgaccaatattcctcgttcttcgggtcggcggcatcgaaatgcgcctcgtcgggggtgacgtggcggaatttgctccggcaggcaatgaccgaggccgggccatcgaatatggcgtgtcccaattcatgagcggcggtgctggcggcgagatcggaccgatccccgatcacggcgggattgaggctgagatagatgttttgggggctgtcggaatcgtattcgcaggccccggccacaggccgccccagttcatcgtgaacctcgttcccgcagtcccagaccggctcgaagcgaataccgttgatcaccagcaattccacccggcggatcagggtgtcggccggaagcggcttgggccacaggccgccgcagatctggcggcgcacatcgcgcgcgatcgaccagatggcgctggcggccagggggcgcgcctcgccggtgggcgagacgctggggaaggttgcggtcacgacggccatcgctggctccttggctgcaaaccgtgacctaatcagtcaacggcatggttcgcatattgttccttaaggctggctttgtcgagtcattccggtggggcggaattgttggcgagcgtccgccgccgtggctatcaaagtaggcatgaaatgccttattttatgcggcattaatgaggggcggaaagggggtttattcccctttattcccctttccgcctctccaccccttcgattgtcgtgcttctgtggcgtccgaaatcaacgccatccagaacgagatcaatcatgggaatgcaacagcaaatcagcgacaaggacatcaccggcattggcttggccaccgcggatcggtgtgcccgccggatcggccgcaccctgcgcctgccgacatcagatattggcgatgtccgccaggacctgctgctggaactggtgcgtcgcgccccccgattcgacggtcaggccggctggccgaccttcactaggctggtcatccgccacgccgggcaggacgtggccgaccgcctcatccgtgatcgccgccgacatggtggatcaatcgacgataccgagcagaccagcgaagacgacggccttgccgcctggtgggcaggcggcgtcaccggagcgggcgccatccacctgcgtctcgacctgcaacggttcttggacggcctgccccagcagttgcggcacctctgtcgcctgctgaccgaagaggatcgcgccacggcccaggtcgtatccggtttctcgcgcagcgagttctttcgccagatccatgagcttcgcatgcgccttcgcgcccatggcctcacccccttgggacgatccggccaatgcgtcggtacatagccaataacccgaaaaacaggacgacgacgatgaccgcaatttccccccaccctgatttccctgcccgttccctgccggtggacgagaacggtatctgcgactggctggccgacgccactccaggggccaccctgatctattaccgcggccatctcggccatgaccggatgcccagcaccaaggtgctgccggaagtgctgcgccgccaggttgtcgatgttgccacccgcattcagcaggcggccgaggccgagcgcgtcttcctgctccagcgccgccttggcgttgatgacttcagctatctggccatcaaggcggcgggccgcccgcgctcctcgatcaccagaggtgaccggcggtgagtttgttctttcaactatccaaggagatccaataatggcgatatccctcgcatcgctgaagcgcagttccgcgctgtcatccccccgcatcctggtccatggcgtggccggggtgggcaagagcactttcgcttcggcggcgcccaatccggtgttcatcctcaccgaggatggcctgggcaccctcgacatcccccatttcccgctggcccgcagcttcgacgacgtgatggaggcgctggccgccctctattccgaggacaacgacttccgcaccgtggtgatcgacagcgtcgactggctggagccgctgatctgggcgcgggcctgcaaggacaatggctggaaatccatcgaggaccccggctacggcaagggctacgtcgcggcgctggacctgtggcgtcagtatatcgacggtctcaacgcgctccgcgatgagaagggcctgacgatcatccagatcgcccataccgagatcaagcgcttcgacagccccgagcacgatccctacgaccgctacatcatcaagctgcatgcccgcgccgcggctctgctacaggagcattccgacgcggtgctgttcgccaattaccggatcagcacggtcaagagcgatgtcggcttcaacaagaaggtgacccgcgctctcggctccggcgagcgggtgctctactccgccgaacgtcccgccttcctcgccaagaaccgctacggcctgcccgatgtgctgccgctgtcgtgggacgccttcgcgtccgcgatgccccaattccaagctcaatcctaaccgataaggaaccatcatggccaatctcggaaatttcgacgccaccaccgtcgatcccgccaaatccgccgacgtgctgcctcccggcaaatacgtggtgcagatcgtcgccagcgaaatgcgcgtcaccaaggacggcatgggccagtacctgtggctggaactcgacgtgctggaaggcgattccctggggcgcaagctgtttgaccgcctcaatctggtcaacaacaaccccagcacggtggaaatggcccagcgcaccctgtcggccatctgccatgccacgggtcggatgcaggtccaggacagcgaggaactccacctgatccccatgctggccgatgtgcgggtgcagccgccgaagaacggctacggcgaatccaacaccattcgctatcagccgctcgaccaagccgccgccgctccggccacccgcctcgctgcggccaccccgccggccaaacctgcgacgcaatcccctcaaccccgcccggccaccgcgccgtggcgccggagcgcgtgagcatcaacaggaacgatgccgccgtcgtccggtcgtcaaacatgagcggcggcggcatctccacccaggacattggagaacatccatggatgacaggatcatagaggcggaggcacctccgagcaatccgcccaccaccagggaagagtgccggcagcgtctggcccaacttcagaacgacatcaccgcgattcgcactgagattgccgccgcagatatggaccgccaggccggtcgtcggccaatggacgcccgctggtaccaccgcgcccgcaccgctttgcgccaccgccagcatgaggcggcggaaatcgccgtcttgatggtccgcctgccgggccgcaaggatgccttgaaggacctgctgatcgaggtggtgcgggccgattacgacgaaaccggctggcaaagggtgatggacgaggcccaccggcgtctcgatacgcggggagcagcaatatgaccgctctgccgccccctcctagccccaccatcgaagcgatctacgccgcctatgaggcctgtgccgaggacggcttccgccttcatctcggcgcatcgctgatcggcaaggagtgcctccgcgccctgtggtgcgacttccgctggaccacgcgggccggctttcccggccgggtgctgcggctgttcgagaccgggcagttggaggaggcccgcatcgtgcgcgacctgcgccgcaccggcgccaccgtgctggaggtcgatcccgaatccgggcgtcaatggcgggtcgaggcccatggcgggcatttcggcggctcgctcgacggcgtggccctgggcctactggaggcgcccaagacctggcatgtgctcgaattcaagacccactcggccaagtccttcgccgatctgaagcgccaaggcgtgcgggagtccaagccgcggcacttcgcccagatgcaggtctatctccacctcaccggcatgacgcgggccatgtatgtggcggtgtgcaaggataccgacgagatttacgtcgagcgcatcctggccgacagggccgtgggcgaaaccctggtggccattgccggtcgcgtcatcaatgccgcccgtccgccggaacggctatcggccgatccggcatggtggcaatgccggtggtgcgaacaccattccctctgccatgacggcggcgccgccgagcgcaattgccgcacctgcctgcattcgactccggtggagggtggttggcactgcgcccgccacgaccgtggcctctcctccgccgaccagcggcgcggctgcgagcttcatctctacattcccgatctggtgccgggcgagcccatggacgccggcgacgatcacgtcgtctaccgcctgaagactggcaccacctggatcgacgggagggtgccatgctgacgctccgcccttatcagcaggcggccctcaccgccatttacgactatttcggccggaaatccgggcacccgctgatcgtcattccgacagccggcggcaaggctctggtgctgtctgccttcatcaaggaggttctggagaactggcccgatcagcgcatcctggtggtcacccatgtccgcgaactgatcgcccagaactatgccgagttgatcggcctgtggcccgatgctcccgccggcatctattccgcagggttgggcaagcgcgacctcggcgcccgcatcctgttcgccggcatccagtcgatccacaagcgggcctatgacatccaacaatgcgatctggtcctgatcgacgaggcccatctgatcccctgcgcctccgacaccatgtaccggcgcttcctcgacactctggccaggatcaatccccatctcaaggtgattggctttaccgccacgccctatcgcctcgacagcggcatgctgcacgagggcggtggcgcactgttcaccgacatcgcctacgaggtgtcggtgcgtgacctgatcgatgcgggatttctctgcccgctggtcagcaaatccgccgcgacgaagttggacgtcaccggtgtcggcagccgtggcggcgaattcatccccagccagcttcaggcggcggtcgacaaggactccatcacccgtgccgccatcgacgaggtggtggcctacggccaggaccgtcgctcctggctggcgttctgctccggggtcgagcatgccgagcatgtggcccaagccattcgggatcgcgggttttcctgcgccactatcttcggcgacacccccaagggggagcgcgaccggatcatcgtcgccttcaaacgcggtgaaatccgggcgctggcctccatgggggtgctgaccaccggcttcaacgcccccgccgtcgacctgatcgccatgctgcgcccgaccaaatcggcgggcctctatgtccagatggccggacgcggcacaaggctgtcacccggtaaatccaactgtctggtgctggactttgccggcaacgtcgccctgcacggtcccatcgatgcggtaatgccctcggctcccggtaagggtgatggcgagccgccgaccaaggtgtgtcccggctgcgacagtatcctggcggcggccatgcgcaaatgccccgattgcggccatgacttccccccgcctgaactcaagatcgaggctaccgccagcacgctggaggtgctgtccaccggcctgccgcaatgggtgtcggtgtccgacatctcctaccacctgcacgagaagcccggcaagccccccagtatgctggtcagctatctctgcggcatggtccgccaccgcgaatgggtgtgcatcgagcatgacggctatgcccgccagaaggcggtgcagtggtggcagaagcgggcacccggcttgccagtccccaccaccgtcgagcaggcgctgatgcaagccgacagcctgagggtgccgatcgagatcgcggtgcgccccagcggccggttcaccgaggtggccggcgcgagattcacatgatctgtgccgtctgcaaccgcgaggggcgcggcttcggctttatcccgcgtcttgcccggctgcgtggcccgcccgaagccgcctgctccatgacctgtctcgacaccatcgcccgctggagaagaaccatgatcgatcccacccccaacgagatcaccgccatggagcatggcggacagatgggcggcgagtatctggacagcatcgccaagaccgatctggcggcattgtcgccagagcaatggcagaccttcgtcgaggcggtgatcaccggctattgcgaccatctgcgtgatctcgccggccgcgaccggggacgtctcgacggcatggccggggaggtgccattctgatggaggccgcccaagacttcatggcccggttcggggcacggctggtggataacggctatccggcgatccccatctggccgggcaccaagaagcctggacgcttccaggccggcgcttggtgcgattacccggcctggacccgccattgcgaccgcccaaccaccctgatcgaggtcgagacctgggccacttggcccgatgccgccatcgggctggcctgcggcaccttggtcggcatcgatatcgacgtgctcgatcccgacatcgcccaccggctggagcggcttgcccgcgacatgctgggcgacacgcccttgctcaggatcggcaaggcccccaagcggctgctggtgtatcgggccgatgtgccattctccggccccaaacgggcgccgctggagatcctggcgcaggggcggcaattcgtcgccttcgccatccacccggataccggccagtcctatgtgtggccggaagattcgccgctcaccgtggcgctcgacgatctgccggtagtcaccgaggaatccgtccgccaatggctcgatgccgccatcgccctgctgcccgatgatctgcgcccggccaccctggtgtcgccgtccgtctcaatgccgtccaccagcccccagcgcggcaccctggcagcggtgcgatccgcgctcgcccacattcccaacgccgatctcgaatacgattcctgggtgcgcatcggcatggcgatgaagggagccatcggcgaagacggggcatcactgtttgcggcctggtcggcaatgtcggccaaggatgtccccgccgccaccgccaaggcctgggccagcttccgccccaccaccatcggtgccggcaccctctaccatcatgccatggagcgcggctggcagccgaatctcaccttggtgctggatggcagcacgtcccaggacgaggtccatcccgccgccggtctgctggccaaactcgcggccattcccgccgaaccgacagcgccggtgcagccgttcgatctcaccattcccgacggcgtgctgggcgacatggtcacctacatgctggccaccgctcggcgcccccagccggaattgtcgctcggtgccagcctgtgcgccattggcgcgctgatgggccgcaaataccggaccgaaagcaacctgcgctccaacctctacgtcatcgccctggccgacagcggctcgggcaagaaccacagtcgcgaaatcatcaacgagacgtttttccaagccaatctcgcccagtatctcggcggcaacaaaatcgcctccggcgccggcctgctgaccgccctgcatcgccagcccgccatgctgctgcagatcgacgagttcgggatgttcctggagggcatcgccgaccgcaagcgcagcccacgccatctcaccgaaatcctcgacaacatgacggagttgtatacatcggccggcggggtgttcctgggtgcagaatacgccaaccgcgacggcaagaacgaacggcgcgacatcaatcagccatgcctgtgcgtctacggcaccaccgcaccgacccgattctggaatgccctgcaatcggccaacgtggtcgatggctcactggctcgcttcatcgtcatcgccagcggcaaccaataccccgacgagaacaacgacaccggcatccgttcggcgccgcccgccctgatcaagagtctcaagctgatcgccgccggtgctggacgaatggcggcgggcaatctctcgggactgacggccgaccccaccaccgccgtcgatccgatgaccgtgcccatggacccgcaagccaaggccatcttccgggatctgtcccgcgatatcaccgtccggctgcgcgaggctctgggcacgccgttcacaccgatcctcgcccgcattgccgagaacgccaccagggtcgccctgatccgtgctgtctcattcgatccagtgaggccggtgatccgggccgacgatgccgaatgggcgattcagttcgtcagcacctgcgccgaccgcaccatggttgagattggccgccgcgtcgcagacaacgacattgagcgcaaccacaagcgcctcctggagatcgtccggggtgctggtgcgaccggcctcaccaagagcgagttgatccgccgcagccaattcctcgatcggcggcaacgcgacgaggtgatcgctgttctggtggaagccggaatcatcgagccgatcatgacggcgacggtgaccaagccgaccatatcgttccgcacgaccggacgggaggcatggtgatgagggaattcttcaacggttggaaaattcatcaggccacacggaacggcccaatcccctgttctaactggggttctgaggaattcttcaaattcttcaattcttcaaccagagaccccgcacgcaggtgcgtggcgcgggcgccatctctctattccctcttgtctgaattattgaattatttgaaattacatatactgaatcaatgggttgacccgttatgggcgcccttgaaaaattcactctatcttgaagaattcgcccgccatcccggcggccgatgggattcatccgtttttgcgccgtatttctccctgccaatcttgagcgacagcaccgccatcggcccggcggtgctgtcgcccctccaagctcaaatctggaggaccacatgacagctttgaccaaaccccagccatgccatgacgccgatgcttccggcgccgtactggccctcgacctgggcaccaccaccggctgggccatgcgccttgccgacggcgccactgtctccggcaccatggagttccgccccggtcgcttcgaaggcggcggcatgcgctacctgcgcttccgttcctggctcgaccacctgctgggcggcgccaagggcatcagcgcggtatatttcgaggaagtccgccgccatgccggaaccgatgcagcccacattttcggcggcttcctggcccatctcaccgcttggtgcgaactcaaccacatcccctatcagggcgtgccggtcggcaccatcaaacgccacgccaccggcaagggcaatgccggcaaggacgcggtgatcgccgccatgaaagcgcgcggcttcaatcccgaggacgataacgaggccgacgccctggccatcctgtcctgggccatcgacacccagggaggtgtgcgatgaagtggcatccccctggcttcggcggcaaccgccgcgaccccgagcaggtcaagcaggatggctggaaggagcgcggcgtcctggtcatcgccgaggacgaccagcgtctcacctggcccgaacgtgaactcatccgacagcttgggcaaaagctctatggcaagcgtcctggacaggaggcgtcccatggctgaactcaaactctcccccagcgaggtggaggaccgcatcaccgaggccgccgacgtgctggggcgactgcccgacacccgcgtgcagggctatgtctgcacctggccgccgatggtgcgcgagtactgggaatcctatggcgtggccgaggtgaagttgcggcggccaccgccatcggccgccgccatcactcgcatggaccagtcactcgaatggctgcggtggctcgacccaatcgacgcccagatcgtctggcatcgagccaacaatgatcgctggaaggccatctgcggcaaggtagggctgtcccgagccaccgttcataggcactggatgtacgcgctgtgcgtcatcgcctggaggctgaacgggaacaaggtgccggggaaacgagcgcgcgggcaccttgtcgagcgtgtcaacgccctgcggcagaaaaatgaaaatgagacatttctggccaggacggattcaccggccgagtgataaattctgggcacgatgacggaagtcgcgagcgggcggcggggtggcaggaatgccccccaccagcctctcggatgaagaaacgagaaagtgaaaagtgagacatttttggtcgggaccgcggccatggtgatgagctagactccttcctgagattgaacgggtcctccctggagcacacgctatgcggggggcatcagcgccggatttcgctagcgacagccaaaaaatctgggtttccacttaggtttccagtttccagcccaaaggcgcgtttgtccaaggacagcgcgcctttcgcatatccgggggcctggaaaccagggtggaaagcacccctggaaacctgaccgggtttccacctgccggtttccagtttccatcagcccaggtttccacccccatgcagcttgctctctccgagccgttcccgccggccaacggcgcgatgtcgtgcgccttggccgccgaagggctggtctatggttcggtgtgcagcgggatcgaggccgcgacggtcgcctgggaacccctgggctggcggccagctttcttcgccgagatcgaaccattcccctccgccgtgctggcccaccattacccggcagtgcccaacctgggcgacatgaccgccatcgacggtcgggcatggcggggcaagatcgacgtcctggtgggtggaacgccctgccaggcgttctcggtggcgggcctgcgcaagtcgctcgacgacgcccgtggcaaccttgccctcaaattcgtggacctcgccaatgccatcgacccagcctacacaatttgggaaaacgtgccgggtgccttgtccacccgcgataacgctttcggatgccttctgggcggattggccggcgaagatggtccgctgctcccaccagggggcaaatggacggacgctggtgttgtgtctggacccacgcgcacagtcgcgtggcgcgtcctcgacgcccaatatttcggcctggcccaacgccgccgccgtgtgttcgttgtggcaggtcctcgagaccgggccgatcccgtcgcggtactttctgagcgcaaaggcgtgcgccgggatcatccgccgagccgagaagcggggcaaggcattgccccgacaattagcgcacgcactcgcggcggtggcgggctcggcaccgatttcgacatcgacgggggattgatcgccgaggccttcggcggcaacaacacctccggtcccatcgaggtggccaccgcgctcaatgcctgcgcgtcggccagcgggcggatggatttcgagagcgagacctttgtcgccaccaccctgcgggcccgtgatctggctcgtggcgtcgatagtgactgcaccgacacgctgattgcccattcccttcgcggcgaaggcttcgacgcctcggaagacggcaccggacgcggcacgccgctggtgccggtgaccttcaatttgcgcggccgggacggcggggcgcaggcggaagtcgacgccgacaacctcgtcagcctccgggctgccagcggcggatcgagccgcagctacgtggccttcacccagaatcagcgggacgaggttcgccctctggacgttgccggtgccctggccgccgagcctgggaccaaacagcagacctatgtcgccttcgactgcaaggctggcaccgggttccagtccgctgaggccgatggcgtcacgccgaccctgcgggccatgtcggccttgggccgcgacaatgccggtggccagttggcggtccagcacggcatggcggtgcgccgattgacgccccgcgaatgcgagcggctacagggatttcccgacgattacacccgcatcccttggcgcggaaagccagcggacaggtgccccgacggcccaaggtatcgcgggctggggaattccatggccaccaccgtcatggcttggctgggacgccgcatccaggccgcaggaaaatgacaatgacccatccgcttccagactctgtcgagcattggcccatcgaccggttgatcccctatggccgcaatgcgcggacccattcggacggccaggtcgctcagatcgccgccagcatgatcgagttcggctggaccaatccggtgctggccgacagccggggcaatgtcatcgccggtcatggccgactggccgccgccaaatccctcggcctggatacggtgccggtggtgatcctcgaccatctgaccgaggcccagcgccgcgcctatattttggctgacaataagcttgcactcaatgcgggctgggatgaagagaccctggcggccgaattgcacgcgctgaatggcgatggcttcgatctcggcgtcatcggcttctccgacgaggagttggacgccctgatggccccccttgatgacgagggcgacggccagggtgatggaaccggcgaggatgaagtgccggaaccgccagccgatccggtgacgcggccgggtgatctgtggattttgggccaccatcgcctgctctgcggcgattccaccgtggtcaccgatgtggatcggctgctggccggggccaagccacacctgatggtgaccgatccgccctacggcgtcgaatatgacccggaatggcgcaatcaggcgggtgtgtcgtcctcagcccgcaccggcaaggtcgccaacgacgaccgcgccgactggagcgaagcctgggcactgttccccggagaggtcgcctatgtctggcacgcggccatcttcgccaagacggtagccgacagcctggaggcgaatgatttcaagatccgcgcccagatcatctggtcgaaaaatcgcttcgttttgggccgcggcgattaccattggcagcatgagccctgcatttatgccgtgcgcaagaacgccaccggccattggcagggggcgcgggatcaggccaccatctgggccatcggcaataacggcgatgaggacgaggccaccgttcacggcacccagaagccggtggaatgcatgcgccgtccgatcctcaacaacagcgccgagggcgattcggtctacgagcccttcgcaggcagcggcaccacggtgatcgccgccgagaccaccggccgggtctgcttcgccctggaactgaaccccgcctatgccgatgtgaccgtcggccgctggcagaagatgaccggacagaaggccattctggatggtgatggccgctgcttcgacgacatcgccgccgggaaggcggtcagcgccgggtgatccggcgtaaggaatgctggtacttggcgtcggtaggtttccaatcaagcggcttgcagccgagccgcagatcacggttccagaattccaggatctgctggttggaatagccccggccccggaagtactcgaaatcggtctgcgaccattgaggatgggccttcagggcagcggcggggcggacggtcaaccgggccgccatggtcacttcgcctcctggccagcggcaaatgcggcttccagggccttcttgatctgccaaaccgacaactcgtggaagtcgaggcggtcgctgttgcgagtgtccagggtttcgaggtcgaggatttgggtggcaatctcggtcaggacttggtctcgggctttcatgttcttggcctccgttgtggtggggccagtaccgctctatgtcgccgacagatcaagtcgattaagcgtgagatttcaataaggtgatcgattgcgtcaatcacgcagcatgtccatggtcgaggccgttgccaacgtggtgatcggctacgccatcgcggtcgccacccaggtggtggtattcccgatctttggcattcacatcaccctggccgatgatctcgccatcggcttggtgtttttggtggtctcgctgatcaggagttacttgctgcggcgggtctttgaacggctgctatgaggatgatattgcgggcttggattcggccgcctctgaatctactcttccggccttgatttccgaggggagagcatcatgagtaaatccgccatgtccaaggccatccgccaagccgctggttgcactgtcgcccaggctgatgccgctgtcgaagcggtgctggccaccatcgtcgaaggcgtcaagaccgagggccgcttcagcctcatcggcttcggctccttctccaagtccgagcgcccggcccgccagggtcgcaatccgcggaccggcaagaccatcgacattgccgcctcgacctcgatcaagttcagcacctcggcggcgctgaagaagtcgctgtagccgatggcggttgaccccgagcatgtggccaaggccgcatccgagatgctggcgcgttacggcatcaatgccgtcgccagggcacaggatcgggtgaatgacgtatcgagggcgggtgatcgcactgccctcgatctcgcaatgttgctgttgaccgaggtggagcgtcaggctgcggcttccgcattctgagcaatccggtacacccggcccctcgtttcaatcttctcgctggtgacgtcaaggcccagcttcttcttcaaggcaccggcgattgctccccttgccgtatgtggcaaccagccaaactcggcggtaatctcggcaatgctggcgccttcgggccgcttcagcatggcgatcagggcctcctgcttggtgccttcgcggggcttacgggccggtttcgcgacgtgggcgtccgtgggcggggattctgcctcgtcggccatgtcagccgccggttcttcttccgggcctgagtccgcgcccgtgtcggcgacaatgcccaacgccatgtaggcggcggccgtggcgaccagcgtcagcgggcttccatcctcgtcctcgcgccagaccggggcaccggcttcaaccggaatcgcctcgatcaagcccttcttgatcatgctggtcagcaccatgtcgaccgctccgcccttcaaggatgcggtgatcggcaggaccagcccgccctcgcgggcgcaggcggcggcgaggatgacggactgggtatcggatagctgaatctgggtcatggttcggttcctctcggggtacggcgcggtcaatccgcgcccagtaccaccccgagcccaaccgggcggacccggtcgggcgatgcgggaaccaagggcgtcaggcggccatgttggccaggagacgccgggcctcgtaaatggccgtccacatggcgcggtcatcggcaggcccatccgttgcttctatctcggtcgcggcgcggtcgatggcccgcaacgttcccaccatggcggcattgtcggcacgcaggcggtcgatctcggtggaatcagtcatccgtatctcctttcttgacggtgctgccggcgaggccggacctcaggctgccgcgtcagccatgacctcgaaatgggtgacgaagccggtgaggtagggcagcccgtgcgggattccggtttcccgcgccgtgtggcggctgatggtccagaccatccagcgggccaccgccgcatcgatcgccgccgccagcccgagaccgcgaaacaatccgttcgcgacgtcgtcggcgaagtggcggccttgggtgctgtcgaggaaatcgcgtaccgccgtgtcggggcagccggtggcgagttggatcgcaggcatcgccaaattccaggcttcggcctggtcggcgtgatcgcccaaggtgccgaaaaagccccaatcaatattggcggtggggaggatggtgttgggcatggtggtctcctctgttcgtgggaccatccatcgctctgtcggcccggcacatcaactggaatagcggatcatttcctttcgttttaaggcttcgatcatgggggtgtccgttcgagaatatgcccgcaggcgtggcgtcagtcataccgccgtgcgcaaggcggtgcaaacgggccggattccccaggagcccgacggcaccatcgacccggtaaaggccgacgccgcctgggatgcccagaccgaccctggccgacgggctacttctgccccgaagccggtcattgaagcgccggcttccccgacacctacgccccagcgcgaaactaccccggttgtcccggtcgccgccgccgccggcgccaccttcgcccaggcccgcaccgcccacgaagtcgccaaagcccagaaagcccgcatccaggtggatcgcctcaaggatgaggtggtcgaccgggcacgggccaccgccctggtgttcaagctggcccggcaggaacgggattcctggatcacctggcccgcccgggtggccgggcagatggcggcggagatcgggatcgacccgcatgtgatgcagaccctgctggaagcccatgtccacgcccatctcgacgaactcgccgccatcgagccgaacttccgatgacgcgtatgggttccgtggggccgatgctgtgctgctggcatggcaggacgggatgcgtcctgatccccgcctgaccgtgtcccaatgggccgatcagcaccgcatgctgtccagccgggcctcggcggaaccgggccggtaccgcacggcccgtaccccttacatgcgcgacatcatggacgcgctgtcgcctaccaatccggtacagcgggtggtgttcatgaaggcggcccaggtgggggcgaccgaagccgggtgttgcttcatcggcttcgtcatccaccatgcgccggggccgatgctgtgcgtccagccgacggtggagatggcgaagcgggcgtcgcgccagcgcatcgaccctctgatcgaggaaagcccggccatccgggaacgggtcaaaccggcccgctcgcgcgacgccggcaataccatgctgtcaaaggatttccctggcggcacattggtgctgaccggcgccaacagcgcggtgggcctgcgttccatgccggcccgttacctgttcctcgacgaggtcgacgcctatccggcttccgccgacgacgaaggcgatccggtggggttggccgaggcgcggtctctgaccttcgcccatcgccgaaaggtgttcctggcctcgacgccgaccatccggggcatgtcgcgcatcgagcgggaatacgaggccagcgatcagcggcggttcttcgtgccgtgccctcattgcgggaccatgcagtggctgaaattcgagcggctgcgctgggacaagggccgccccgagacggtgcgctatcactgcgaagcctgcgagcaggagatcgccgagcaccacaaaggcgcgatgctggcggcaggcgtttggcaggcgacggccacgggcactgatcccggtaccatcggctttcacatctcggcgctgtattcaccgccgggctggcaatcgtggcgggacatcgtccgcctgtgggaagcggcacaaggaaatgacgatgcgctgcgggtgttcaagaacaccgtgctgggcgaaacctggaccgaatccggcgaggcccccgactggcagcggctctacgaccgccgcgaaaactgggccaatggcagtgtgccggaaggcgccctgttcctcaccgccggggccgatgtccagaaggaccgcgtcgagattgatgtctgggcctggggccgcaacctggaaagctggctgatcgaccacatcgtcatcgacggtgggccggaacatgccgaaacctggactgcgttggagcaggtgctggcgaagacctggcaacatgccaacggcgccgccctgaagatcgcccgcctcgccatcgacagcggctacgaggcttcggcggtctacacctgggctcgccggatgggcgtaggccaagtctcgccgatcaagggcgtcgagggcttcaaccgctccagcccggtgtcgggccccacctatgtggacgccaccgagggcggcaagaaggtgcgccgtggtgcccgcctctggacggtggcggtgtccaccttcaagtcggagacctaccggtacttgcgcctggagcggcccaccgacgaggaactggcctcgggcatccgtttcccggccggaacggtgcatctgccatcgtgggcggactcggagtggtgcaagcagttcgtcgccgagcagttggtgacggtcaagaaccgacgcggcttcaccaagctggaatggcagaagctgcgcgaacgcaacgaggcgctggattgccgggtctatgcccgcgccgccgtctggatcgtcggtgccgaccgctggtcggaggccaagtggcgggatctggaagcccagattggcccgtccgagacggttcaacccgaagaagcccaggcgggtcagatccgccgcaccgtccgtcgcccccggcggatcatcaagttcagcgggatgcactgatcatgactctcgacgaaatgaaggccgagcgggaaaaggtgctggcgaggcgcaactccctggtggcccgcgtcacggtgggcgaccgcaccgtccaatacgacctgacccaggccaaccatgtgctggccgatctcgaccgccgtatcgccatgctggagggcaagaagccccgtcggcgcatcctcgccgtcgccaccaaggggctgtgaccatgctggggagtttccgccgtcgcctcggtgccctgatcggcggcttcgaggccgcccagggcagccgccggctcaagggcttccagcccagccgcgcccatgtcaacaccctgatcgcggctgccggttccgacatcacggcgcgagcccgttatctggtgcgcaataacggctatgccctcaatgccgccgaaagctggaccggcaatgccgtcggcaccggcatcaagccgtcatccctgatcgccgacaaggatctgaaggccctggtgcagcagctctggctggcctggaccgacgagtccgacgccgaggagctgaccgatttctacggccagcagcgccgagccgcccgcgaggtgttcatcgccggggaagtgttcttccgcctgcgcccgcgtcgcccggaagacggcctgacggtgccgttgcagcttcagatgctgccgtccgagatgctgccgctgacccgaaccgaggttcttcccaacggcaacaccatccgtcagggcatcgagttcgaccgcatcggtcggcgggcggcgtattggtttctgcggcgtcatcccggtgatctcaccgatcccggcatggtcggcgaaatggtgcgggtgccggccgccgagatcatccacgtcatcgacccggtggaatccggccagcttcgcggcgtctccaggctggccccggccatcgtcaagctgttcctgctcgatcagtacgacgacgccgaactggagcgcaagaagatcgcggccatgtacgccatgttcgtgatctctccggccccggccgacgtgatcgacatggtgcccgccgacgatggttccggcgaccgcatcgtcgaggtccagcccggccaagtagtgcccttggagccgggcgagcagatccagacctcggcccccgccgatgtcggcggatcgtatgagccgttcgagtaccggacgctgctgcagatctccgccgccaccggcatcccctacgcctacctcagcaacgacatgctgaaggccaattactccaactcgcgcatggcgctgctggagttccgccgccgggtcgaggcatggcagcactcggtgatggtccaccagatgtgcaggaaagtgtggcagcgctggttagatgtggcggtgctgtccggggcgctcgacattcccggctacgagcgcaaccgcgccagcttcatcgcctgttcctggctgccgccgaaatgggactgggtcgatccgctgaaggacgccaaggccgagatcgagcagatcggggcgggtctgaaaagcaggacgcaggcactggccgagcgtggctacgacgccgaacaggtcgatgccgagattgccaccgaccgggaacgcgaacagcggctggggctgaccttcggttccgatccgtcaccgctcttgctgcccccaccgacatcgtaaggaccaccatgcacgatctgccccatctcgcggcccgtctctacggggcgccgctactggtcgcccgcagcaagctggacgtgatcctggccgcgctcggtccccggctggccgggcaggcggcgcctttcgacggggatgccattccttccgacgatgtggaggtcacgcccgacggtatcgccatcatcccggtggtcggcaccctggtggcgcggtcgggctacctgggtgccgcaagtgggctcactgcctattcggacatcgccgaaaccatcgaggcggcggccactgatcccggcatccgcgccatcctgctggatgtggactcttccggtggcgaggtcggtggcctgttcgatctggtcgaccacatccaggccatccgcagccagtgcggcaagcccatctgggcggtggcggacgaggcggccctatcggcggcctatgccatcgcctgcaccgccgaccgcctctacgtcacccagaccggcgaggtcggctccatcggcgtggtcgccgtccaccgcgacgaatcgggggccgatgcccaggctgggctggcctggactttcgttcatgccggtgccgccaaggtcgatggcaatccccaccagccgctgtccgactctgcccgcgcggccctccaggccgacgtcgatgccctctatgggaagttcgccaccctggtggccgagcgccgccgcctgtctcccgacgcagtgcgggccaccgaggctgtggtctatcgcggcgaccaggcggttgccgccgggctggccgacaaggtcggtaccctgcggcaagcgctggccgatctcggcgcatccctgacccgtccctccgtccgtacccccgtcctgtccagacccaaggagaccaccatgtccgagcaaacgggggacatccctatcaacgaaaccgaacgctccactccgggagccattgttccggtgcccggcgcaataaccgcccaggtagaacagcgcctgcgcgccgaatattccgagatcagcgccatcgccgctcaggccgcccgcctgggcgtgaccatcgatcccgccgaggccatggccaagggcatccgccccgaggcgctgcgtcgcaccgtgctggagcaactggccgagcgctccgaggccaccgatgtggtcgccgccgctccggcgggagccgcccccaagtccgaaaccgaaagccccatcgtccggcgtgcccgcgaagccgccgcccggaaataaggacaccccgccatgcatgtgctgaccgcttcgcccaccctgggcgatctgctgaagtttgaactgaacgccagctactcccgcgagaccgtgacgctgaaggccgggaccagttatcccctgggttccgtgctgggccgcatctccgccagcggtgaataccgcctgtcccccgccgccgaggtggtgggggacgaaggggcggaggtggccgtcgccgtgctgctggacgcggtggacgccaccgacggcgtggccaccggcctgatcgccgcccgcggccctgtcatcctggccgataccgccctggtgttcgacgcctcggtcgaccagcccaccgaacgggccgccaagattgtccagcttgccaccgtggggctggttgcccgcgccaccgtctgatcggagcctttcccatgacccagatcatcaatcccttcgacgtgggcggctactcgctcgccgaaatgacccaggccatcaacatcctgcccaacctctatactcggctgggccagatggggctgtttcgcttcgagggcgtcacccagcgcagcgtcatcatcgagcaggccgagggtgtcctcaacctgctgcccaccgttcccctgggcggcccggccaccgtcgccaatcgtgatgcccggtccatgcgctccttcaccgtgccgtggattccccatgacgactccatcacgccccaggatgtccagggcgtgcgcggcttcggcgtcgccgatgccgccgatcccctggccacggtgatggagcgcaagttgacccgcatgcggagcaagcacgcccagacccgcgagttcatggaggtcaatgcgctgaagggcgtggtccgcgacggcggcgggtccaccctctacgattatttcagcgaattcggccttgcccgccagcaggtggatttcgccctgggcaccgccaccaccaatgtccaggccaagatccgcgacgtgttgcgcaaggtggagaccgagctaaagggcgagaccatgaccagcgtgctggccctggtcagcccggaattcttcgacaagctgatcggccatgccaaggtcgagcaggcttaccagtattattcctcgaccggtgctcagccgctgcgggaagacgtccgccgccgcttccccttcgccggcatggtgttcgaggaatacagcgccaccgtcaccctttccaccggccagaccgaaaccctgatcccgccgggcgaaggcatcgccttcccgctgggcaccatggacaccttcgtcacttatggcgccccggccaatttgatcgagaccgtcaacaccctgggcgttcccatgtatgcccggcaattggcccggcaggacggcagcgccatcgacgtcaagaccgaggcgtccatcctgccggtcaacaagcggccccgcctggcggtgcgtctgttctcggggaattgatgagcgcctttgcggatgccatcgacgacctgatcgccgatccgaacatggccgtcgccgtgacctaccagggcagccccgtgcgtgccctggtgcgacggcccgaccgcgacatcgagttctcggacatcaccgtccacacggggacggcggtcttcgagattcggcggggggaggttccggcaccccaggcgggggatgtgatcgtccatgacggcgacagtttcgtcgtccaaggcgaaccccgcctggatgccgagcggttggtctggaccttggatacgagaccggcatgaaactggcggcggcaatttccggcgatctgcgcaagatcatggccgaggaaatcaaggccgccgaggacgccgtcaccgccgccatgcgccaagccgccgacggattgaaggccgatcttcgccgccaggtcaccgaggctggcatgggccagcgcctcgccaacacctggcgggccgagctttatcccaaggggcgcaacagcatcaaggcagcgggcttcgtcttcaccagggctcccaccatcatccgcgccttcgaccagggtgccgtgatcaaatccaagcacggcttctggttggcgatccccacgcccgcagccggcaccggcgcccgaggcaagcgcatgacgcccggcctgtgggaacagatgcacggcagccggttgcgatttatctaccgccggggtgccccctcgctgctggtggccgagaacatgcgggtccgcaccggcaagcggggaggcttcgccaagggcagcgcctcggcgctccgctccgggcgcgggatgaccagtgtggtgatgttcatcctggtgccgcaggtgagcttgaggaagcgcttagatgtggacggcgtcgccgaacggtgggcttcggcgctgccggagctgatcgtcaggaattggcggaattagggtccgtaaccggcggcatcccggccacgctatagctggtgcgtttgctgccgcccggattgcggaccagaatgccccgttccagtaggtcattgatgtcacgttgggcggtatcgaccgagcatttgccgatggcggcccacttcttggcggaaaggttgccctcgaatccgtccatgaagcgattgaggacggccttctgccgggccgacatcggttcggaggtgaagcgccgccagaactcggctttgcccagcacgccctgggccgccacttcggcggcatcgatcgcccggccatagcattggatgaaccaggacagccacgcggtgatatcgaggctgccgcgctgggtccgctccaggatttcgtagtaatggctgcgttcccgctggatctgcgccgacatgctgtagaagcgctggccagtgccctccatctgggccagggcgagatcggcgatggtgcgggcaatgcggccattgccgtcgtcgaacgggtggatcgtcacgaaccacagatgggcgacggcgctgcgcagaaggccgtccatggccgggggctggttgaaccattccagaaattgctcgatttcgctcccgacctgctcggctggtggggcttcataatggaccttggggcgttcaatcgggccggacaccacctgcatggggccggcactatcggtgcgccagtcgccaatggtgatcttgtgcagcccggaccacccggtcgggaagagcgcggcatgccacccgaagaagcgttgctgagccagggggattgcgtgattgcgcagggcatcgagcatcatctcgacgatgccgtcgattttgcgatctgggggcagcacgctgccgtccggcagccctaaacgccgggctaccgaagagcggacgctggccatatccagccgttctccctcgatctccgaggtcttgatcacgtcttcggtggtagcccggagttccgcctcgcacttaagatcgaagccaagacgctgcatttggccgagcagatgcccctgcttgtggcgggcttccgccaggggcatcagcaacgcttgggcatcccagcggaattggggccagttgtcttctctccagatgtacacggcatattctccgcagaagttacggagaatatgccgtcattcgctgcaggcagcaacgtaattcaccgcacatgttgcggagaattttgagttattcgccgcatgagcagttattcgagatcgggaaagcatggccagtgtccgcgaacagatcctcgccgccctgctggcgcggctggaaacggtgcctggcgccacggtcaaacgggaagcgccgctgcccgaaacggtctccgccgggggattgatcatcctgcgcgacggcgatcccggcgacccggaggtgatcctgtcgcccgtcacctatctctgggaacaccaggccgagatcgaggtgatcctccagcgcggccaggatgacgacagcgtcgctctggacgtcctgctgatggcggtggggcaggcccttgccgccgaccgttccctcggcggtctggccgaatggctggactggggggctcccaagacctccggcctcgccatcgacggggcagcgtccctgctgggcgccacggtaccggtcaccatccattacggctccagcgacccgctgggctgagcctcaccttatatatgggagtttcccatggcgaaaactcgggcctatggcgccgattgcgcgctgctggctgccttcgaggcgagctacggggtgcttccggccgacggctatacaaggctgtcgttcaaggaatccagcctgggggccgagcgcccgctgggctacgacccgctgctgggtcagggccgcgatgcccaggatccgttctatgaggcgatcaaggacgagggcgatgtcggtgtgccgctggatgtgcgggcgctcggcttctggctcaagggcttgttcggcgcgcccgccaccgccgataatggcgacactaccttcaaccatgtcttcacctcgggcggcacactgcccagcctcgccatcgagatcggccatgcccaactggcggcgccgaagttcttccgtcacggcggcgccaagctggacaagctgtccttcgacatggcccgctccggcgccgccaatgccagcatcggtgtgatcgcccagggcgagaccgaagcggccaccaccatcgacgccaccccggcgacctttgccctgaagcgcttttcccagggcagcggcaccatccgggtcggtggcggccaactggccaacgtggtcggcggcaagctgtccttttccaacaatctggagcgggtggagaccatccgcgctgacgggctgatcgacggcgtggacgagaccgaggctaccgccgagggttcggtggacatccgcttcggcaccgacaccacgctgaccaccgccatcgccgccgagagcccggtggcgatggaatatggtttcaccattcccggctcggcctttgccctgaccttccatctgccccgcgtcttcctgccgaaaaagaagcaggagatcaaaggccccggcggcatccaggccagctacgactggcgggcggcccgcgatccggtggcgggatatctgctccgcgtcaccctggtcaacgacgtggcggggtactgattatgatccgcctgaccatccccaaggaaccctactggatcgatctgccccacggtgtccgggtgttcgtccgtcccctgaccacggcggtgtacgaggccgcccggtcacgcggctggcgcatggcccgtgccatcgccgccgagcatgccgatctcaaggcggcgggggccgatatcaccggtctgcccgatctgtccgacgaggacgccctggccgggctgtcacagatgttgtttgcccaaggtctggcccgttccgccatcaccaaatgggagggcgtgctggacgtggccgatcaaccggcggaggtcaccgacaccgccatcgccgagctgatgcagcttccccgcatggccgagtccttcgtcgtccaatacaccgaaacccatgaaacggtcatcgccgagggaaacgtctccaggcccgcgccgaatggcacttcggcggcgggcctgactactgccgaggctgcggtggaaactgcgactgcccctatgaccgcaacacccccctgagtgaatccggctggcaagcctgggaattgctgaccggggccatcggcgccatccgcatcggcccgcgtggcggcatcaccgggctcgaccttcccgccttgctgatccaggccgaggcactgggttacgaccggcctttgctggttcggctgctgcctttcgtcgagcggggaatggtggccggttccgccaaggttcaaaccgagacctgatccatggcaaccaaatccgtctccatccgtctgtccctgcaggacggcgaaaccgttcggcggagcctgatccaactgggtaacgacggccagaaggcgctggccaggattgaaggggcggcgcaaccggcgtcgaagtcgctgctggcgatgaatgccgccagccaggatatccagggcggcatggcggggtttgcttcccggcttggccccatcggctcggtgatgatggcgttgggtccggccgggctggcggcgggcgcggctatcggcttcttcggcaaggccatggtggagtccaccatcaaggtggaaagcctggaggcccggctgaaggggctggtcggcgccgccgccctgaccgaaaccaccagctatctctatgcccaggcgcagaagaccggcacggcgctggaaacggtggtcggggcctattcccggctggcggcgttgcagaaggccgggatcatcaccaccggcgaaagccgcgccttgctggaagggtttcagtccaccgccatcgcgctgggtgcctcgtccgagcagttggagcaatcgctgttcggtctggcccaggggctgtcgtcgggcacgctccgcgccgaggaactcaaccagatcgtcgaacccatgccgggcctgctgcaggcactggaccgagccgccgctctgccctcgggcgggttccgccagatggtcacccagggcaaggtcacggcggattttttccgcgacaccctgatcaaggcgttgcggggcttcgacgaggccgccaaggaaagcgccgataccgccgagcggtccttcacccgcatggccaatgcctggcagggatttaccaacgctccctggctgcgcaaggttctgtcgggcggagccaatgccggggcggcgacgctggaatcgctgacgccgggggaatcgacggtcaagtcgcggctggccgatctggaccgccgcatcgccgccctggggggcgagcaggcactcgataagccgttgccggcgggcacccattccgtggtggtgcaggcggtcagggaggaaaacgaggaactgcgccgcctgctggccgagcgccaggatgtcgccgccgatctcgacgagatcacccgcaagcgggcgggcatggaagcccatgccaagatggagcgcgaccgggtaagggccgagcagcgcgagccgacctatatcgagaagctgtcggatctcaaattcgaggtggaatggcaggagaagctgaatgcggcccgcgccgccggcaacgccgaattctcccgcaccaaggcccaatacgaggcggccaagggctttcgccagatcgagaaggagctgttccagcaaggtggcgtctatcgcacccagcccaaggaaaaggagatcaaggatctgctggcccgcgaggccgaggccaagggggcgggagagatgtccgcccaggcccaggccgaggtgctgggattgaacctccaggcccgtggacaggagcgtctggccgaagccgcccgcaccgggggacaggcccagatcgacgcggcacgatccgccaaggtgctggagttcgccttcaagaataacggcgcggcggtggccgaatacgatcgggcgctgcgccgcatcgatgccgccgaactgttggagcagaagaacggcctgatccgcaccatggggcaggaagtcgccgccaatgatcgcctcgccgattccgccaaaggctcggtggccgacaccatcctggcggaacggaccaactggctggccgaacaggcctccaaggggctgagtgatgccaatggcgacttggctgcctcctacgcccaggtgcagaagtcccgcgccaacagcgaagccgcccgtgccgttgccgatctggagcgcgagatcgacgcccagatacggctggcggaggcggtgcgcagcagtgatcgcaccaaagtccgtaacgtcaccatcgacaacgacgtcgccaaattcgcccgcagccacaagctggccgaggatgatcccaaggtcgatgagtaccgggcggcccggtcccgccaatacgccgaagcggtcaaggacgaggcccgacaaaccactctggcctatgacgccaccctgcggttcaaggatgaactggccaagctcaacgagcagcgggccagcggcgccttgtcggaggaggcttacacccgccgctatcgggaattggagcaggacaagctggccgccagccgcgactggcaggacggagccatccgggcggtgcgggcctatgccgacgaagccagcaatgccgcagccagtgccgaacgtgccatgtccggagccttgcgggccagcgaggacgccttcgtcaaatgggccatgaccggcaagctggccgggcaggatctgttcaacagcctagccgaggaggccctgcgcgccgcctggcgcatgtcggtggtggcgccgctgttcggcggggccggtggcggtatcttcggcggcatgatcgccagcatcggcagtttcttttctgggaccgcttcgggcggcgccagttccggcggtgcggcgccggtgcccgataccggcaacttcgccatcgcccataccggcggcttgatcggtctcgaccggctcgatactcgttcatacagcgcgtcggtgttttccaatgcgccgaaattccacggcggcggtctggtggctggcgaacgccccatcgtcgctcgcgtcggcgagggggtcttcacgccccggcagatggataatgccgaccgcatcctgaacgccgccctgtcgcagccagcgtcagtgggcgtggtggtcacggtcaacaatcatgcgtcgggcacccaggcccgcgccgagcaatctcagggggcggatggccgcatccatctcgacatcatcgttgaggagattgaaggccgcatgagccgccgcatcggttgcggcgagggcatggccccgatgctggagcatcgctatgggctgaacccggcggcagggacctatcgatgaccacgctcgtctcctggcccacccggttgccgctgccgacctatgacggttatgccctggaaccggaatcggccgtcacccgcaccgacatggaatccggcccagcccggcagcggcggcggttcacccaaacgcctacccgcatccctgtgcgctggcgcatgtcggcggtggatttcgccaccttcgaggcatggtttcgcctgaagctggacgatggcgccgactggttcgccatctccctgctggttggaagcggcattgtcgcccacgaggcccgtttcgttggccagggcaacaccccctacaaggcggtgcccagtcgaggcggggcttggatcatcacctcggtgttggaagtccgcgagcgccccatgctcgacgagggggcgctggagatcctgctggccgaggatgtggtcgttctctttgccaacatccagacccttcataccaccctgcatgtcggcttgcccgtcagcattcgctggtgatcatccatgactctgcaaaccgatctcgctgctgccgtcgccaaggtgaccgcggacagcaccctgctgcacaaggtggtgcatggccccgccagcgggaccgagtgtcaggtcgtcaccgagggtgggaccgtcaagacggtggcgaaggctatcgccgatatcgatacccagcttcagtccggtctgaacaccttggaccagaaggttgctgcagcggccgccagcgcggcgcttgccgtcaacagcgccgatgcggtggaaacgagcgaggcagccattacggcaaacgcccaggccgcccgtcagtcggaaacgcatgccgccgccagtgcttcatccgcatctggcaatgctgctgcggccaatgccagcgcggtcgcggcacaggcatcccggcaagcctcggaaaacgctgccgcccaggcggaacaggcccggacagccacggtggcggcgaaagccgtcgccacgcagtcggtaatcgatgcaggagcttcggcatcggcagccaacgcctccgccatcgcggcgaataccagcgaagccgccgcccaggcgagcgcggaagcggcggccctgtcggaacagcagacggcggcctcctcggccttggccgtggccgccgaggccagggccaccgcgtcggcggcccaggcccgcgcctcggaaaccgccgccgcagactcggcaattgttgcggctcaggccgaaaccgacggcgccttctgggccggacaggccgagagcttcgctgtcgcggctgaagcggcggccaccatcgttgccgatgccaccggacttgatctgcaaactctgatcgtttccgcccgcaggggctcggactaccggacgctcggcatcgagttgttctgaggggacgcccatgaccacccttgcccattacctgacggtcaaggccgcccaggacaacggcttcgccaccatctcgaccaagctcgacgatcccagtctccggatggacgatttcgcgctgatggtgaaggccatcgagttgatcgaaaccgtccaggacaccgatgcctacgacgccctgctgagcaaggtggcgaccaaggccgccgaactctacgccacggacttaagcggcgaggccatcctcatgctcacccgggcctcccggctgggcgacatcccccatggcggggaggagcggtggatgctgcttaaccgcgacgaaaggaacatggatgtcaccggcgccgtgatggtcggtgaacgcagcctggaatcgttcggcgattgcgtcctcgaaaccttctacgcggagacttgatcccatgcccctgaccatcaccccgatccccaatgcggctcccttcacggcgttctccgacaatgtcggcatcttcagcaattccaaggcccgcgaaatcccggcccggctcaatgccatcgcccagggcctgaaggatcacatcaacacgctctggctggccacggccaccagcttcatcaacggcacggtgatcgccggtctcaacgccgcccttgccaagatcgagaccttctccaacgggatcgaaacccgcatcaacaatcagatggccgagtttcaggtcaatctcgccaattacctcggaaccaatgccgggtattcggtcagtgccgccaatgctgccctgttcacggggggcatcgtcgcgggtgacgtcgtctacgacgttgcgggaagggcggcttctatccggcagggcccgcgtctgatcaacggcatcacctacaacgacgacggaaccatggcgggctacgccgagaaactgaccttgggcggcatcacctacacccgcgcctacagcttcacctatacgcccgacgggcagattgccgccattacggaggtttgacgatggacatcctgacgttcaacgcgatgaaacagtaccagcgccgtattgacagcgatctgctcgacccctggaagcgcccggccttcgccgtggtcaccatgagcagctcggcgccctggggtaccgtggtctacaaccactatctccaggagctttgccgccagcattacaatgacagcggctatatgcagggcagcaccagcagcttgggaaccgagttcttcaacaactggtattcctacggccagaccaactcgaacatctcgtcgaccgacacctcctacggtgacggcacggcgcggtgcgggcatctcggccatatcgctctcggcgtcggtcccgacggttcgatgatcggccgccccagcccctatgccggcacggcgctgaggaatgtcggcgtctgggtcaacaacaagaccaacaagaacctcgccctgttcatggagaaccagtacgcaggcgtggcgccgcgtgccatcgcgcctggccgcctgaccggcaccgagggctggcacctggcctggaccaacaccaagttctacgcccagaacaatttcggcacgtacaacaagtacgggatgatcggctacaacgagaaaaccggcacgttggtcatcaacgagaacaggaatggtggcacctccatgaggctgcacgtctattccaatgtcccaccgttcgacatttccgccagcaaccgccgcgcctggttcaacaatctcgatgagaccaagcacatcttctacgactggacggccaattcggccgggtatgccgagagcctctatcgcggcatcgtcattccctgcgacgacggcaagatcatcatcgtgcggatggagcccagcaattactgcatgctggaccggttcacgccgaacggcgccggtggctacaccaaggaagccacccacaccctgagcacgaccaccacctacggcatggaatccgccgaccgcaacggcatccgcttccagatctccaacgacggcaaatacgtcatctgctaccagccctattactactatggggccggggctgaggtgttcctgatccgggtgtcggacgggaagtacgccttcctgcaataccaggattccagctatggccggtcgttcgcgcccatccgcgacagcgacttcatgatctcctacagcccgaactcggacagcggctacggcatctacatgtcgcacatcgacacccggacggtgtttcaggccatcgccgacaagggcgacatgagctccaaggtgccgggcttcaacgtctacatcttcgacagcgcctatcactcgaccaactacccctacatcgtcccgatcatcggaggcatctgatcatggccggcaaaatcagcttcccccacggcaatgactggggcgtcatcggtcccgagggcgaccacgatctgccggtggactcgaccctgggtcaccggttccatctcgtcgatggcgaggtcatcgaccgctacgacggcgccaccgacgacgaggtccgcgagattgatgccgcgcgcgtcgtcgagcggcaggccgaggaactccaggcggccagaaccgccctggttcgccgggtcaaagccgaagcggcggggcgcatcgccactctcgactggaaggtcgaacgcgcccgagagcgggatgccctgaacgggaccaagaccctccaggatgtctatgccgagcgtgaggttattcggcgggcgagcaacgaggccgaagccgctatcgccaagctcacctcccaggaagagatactggccttctcctggtagccccttccaccgacccggaattcaatgccatgaccgaacaatccccggaaatctgggcgggcgtcgccacccagtatgtgggcgcgtgggggcaagcagcccccatggtccaaatcgccgccatcaccgccacggtgatcataattgccatcatcgcctgggcatggtcgcggaagcagggggcgccggatgcgtccggtgtccccgtcgaggccttcgcccatgtggtcgaggaacaggcccgccagaccgaggcgctccgctccgcggtcgagggcctatccgagatcgtccacgagatgcgcaagctgctggcggccaggaccttctgcccgttcccgtcgcccatgtgcgtgcccggcaaggacaaccatgcctgatccggcattgtcgcaggcgctgaaggaggcgtttgcgtccgccccggccggaacggtggttctcgatacgttggagatctggcatccaacctttgacgagccgatccgggtggtccgtgaccacgccgatctcaccgcccggctggaggccggcgccccccgcgatggcggcaaacgggtgaccttcgccgcgctggcttttgagttctcgccgccaccggtggataccgctccggtgccggaaatcaccgtcaccctcgacaatgtcggcagcgacatcaccgatgcccttgagggcgctgccatcagccagcaggtgatcgagatcacctggcggccctatctctccaccgatctcaacggcccccatatggacccgcccatcaccatgaccctgaccgaggtcgaagccgacacgatgagagtcacggggcgcgcccgcatgctggatgcggggaacaagtcgttcccctccatcacctataccgcccggcgctttcccggtctggcgcgctgatcttcgcagggcgctgccctgtccttagacccggggggcatacatgccccagggcacctgccagggactcgtccctggaccccattccttcgagggcatcatgcattgggctgccgcttatatcggcctgccgtggtccgtccacggcagcgggccggacctgttcaattgctgggaattcgtccgcatggtgcaggcccgacatttcggtcgtctgctgcccgagatcggcaatccagaagacatgctggtcatggggcggacctttcgcgaccaccccgagcgtcgccgctgggccaaggttgacccgccagcggagggcgattgcgtgctgttgcgccggtctcgccatcccatccatgtgggcgtctggctcgatgtggatggcggcggcgtcctgcattgcgccgagggcgccggggtggtgttccagcgttcggacgcgctcgcgctcaacggctgggccatcgaaggtttctaccggttttcgccatgaccgcctccatagttatcgtcaccaatcccttcgagccggtgaccagccgctcggtgcatgcggtggaatccgggatcacgctgggcggcctgttgcagggttgcagcattgccgaggattgctggtccgatggcccggaaatcctgatcggcggcatggcggtgccggtcggcatctatgccgtccgggccatcgcggacggagaggtcgtcaccgtcattcgctggccccagggcggtgggggcggtggtgggggcggcaagaaccccatgcggatcgtgttgaccatcgcggtgatggtggccgccatctatctgggccccatggcggcggtggccatgggctataccgccgctggcagtgccgccgccatggctaccgccggcatcgccatggtcggttcggtgctgatcaatacggtgatcccggcccccaagccctccatgccctcgctcaactggggcggcagcggcagcgccccggcccccagcccgacctattcgatccaggctcagggcaaccagggccgattggggcagccgatcccggtaatctatggccgccacctgatctatcccgacctcgcctccgagccctaccaggattacgtcggcggcgagcagtacctgtatcagcttcacgtcatcggccagggggagtatgcggtcgagcagatccgcatcgaggacaccccgatttcctccttcgaggaggtccagaccgaaaccgttccgcccggcagccgggtcaccctgttcgagccggatgtggtcaccgccgccgaggtggcggggcaggaactggtggctcccaatctggcgcaaccgggcgacgacggatatattggcccgtttaccgccaacccggtcgataccacggtcggggcgctgggcatcgacgtggtgatgccgcgtggcctctattacgccaatgacggcggcagccttgatagccgcaccgtccaatggcaggtcgaggcccgcgccatcaatgccgaggggggagctattggcggctgggcggttctggcgcagccgtcgcatagtgccgccaccaacagcacgctccgtctgtccttccgctattcggtcagtccgggccgttacgaggtccgcctcaagcgtctcgacaccaaggataccgccgaacgcgccggccacgaaatccgctggggtgctctgcgcgcctatttgaccggccagcccgatttcggcgccgtcaccctgctggcggtcaagatgcgggccaccgacaatctcagccagcgctccagccgcatgatcaacgtcatcgccacccgcaaactgccggtatggtcggcggcgggtggttggtcggccccgcagccgacccgttccatcgcctgggccttcgccgatgcctgcaaggcggactatggcgccaagctggccgacagccgcatcgacctcaagacgctggccgccctggatgccgtgtgggctgcccgtggcgattccttcgacgctgtattcgacaccagcatgacggtgtgggaggcgctgacccgcatcgcccgctgcggccgcgccgtgcccatccagcagggcggcatcgtccggatcatccgtgatgcgccccagaccatgccggtggccatgttcgggccacgcaacatcgtcaagggctcgttcaagatcaaatacgtcatgcccggcgacgacaccgccgacgcggtgaccgtcgagtatttctcgtcgcgcacctggaagcccgacgagaccacggtcaagctggccgacagccagggcgacaacccggccaaggtcaacctgttcggctgtaccgccaaggatcatgcccaacgggaaggtctctacatcgccgccaacaaccgctatcgccgccgcatggtcaccttccgcaccgagctggagggcatgatcccgacctatggcgatctcgtcgccatcacccacgacatgccccgctggggtcagggcggcgaggtgatcgattggcgggccgaatccgcgaagccgccctggactggggcggttctgatgctgtccgaaccgctgacctggaccgagggcgccagccattacctggcgctgcgccgccgcgacggaagtctggcggggccgttccgggtcgagccaatggccgatgcgcccaccatggtgcgtctcgccgagccgctgaccgtcacgccttataccggcggctcggaggagcggacctacttctccttcggccccggccaggcatgggcccaatccgcccgcatcctcgccatccgtccccgcgccgagcaggtggagatcaccgccgtcgccgaggatgctcgagtgcatgtgaattagccgtctttcatttcccgtccccacagccgcctccgggcggcttttttcgttggagaatgaccatgacccagtcctgcaccattcctcgcggcattcgcctcaacaatcccggcaatatcaaggaatcccccggcgacaagacccaatggcagggcgagcgcgccaccgatgacgatccggtgttcgaggagtttgtcagccctgaagcgggcattcgggcgctgacccgcattctgctcagctatcaacgccgctacggcctgaacaccgtcgccggaatcatcaatcgctgggcgccgggctgcgagaacgacaccggctcctatatcgcccatgtcgcttctcgcctgggcgtgacgtccgatcaggccattgacctgaccaaggccgacaccatggccggactggtcgaagccatcatccgccatgagaacggccagcagccctacgccagagaggtgatcctggcaggggttggcatggggctggggagcgcttgatcatgaatctgctcgatctcctcggcgatgccgccgccatcgccgccaaccccatcgcggggctggccaaggtggcgctggacgtggcgccggacatcgccagcctgttcggcgacgatgccgagaaggccgtgggcaagctggccgacagtgtccgcgccatcaccggcaccgacgatcccgacaaggcccgtgaggtgctggccgatcccaatctggtattccagcttcgtgcccaggcgcaaggattcgcccatgccgaacgtatgcagcagatgaccggggccatcaccacgctgaccgctaccctggccgaccgccagaacgcccgagccagggacagcgagttcatcaaggccgggcgcagcaacactcgcgccaacgtcctgctggtgaccgctggactcggcattgtcggcgggatcggcttcatggtgttcggccatgtggacggcaacaccgccgtcggcggctgcatcatctcggtggtgacactgcttgcgggcaagttcgccaccgcgtttgattttgagttcggcggctcggcggattccgagcaaacccgcactctgctggcgcaagcaccacccattaggtaagtcgagcatgacgcagtcgaccgagggagcatcccccggtcgaccgtatttttgcatttggggcctacgataaggcaggccagtagtgggcttatcccctccaccgccaaacagaggaagctaaagctgcccccaaaagtgaggtgggatctcttgtgccatgctcaatgcacctttacatgcttccataagcggctcattggcaatgctaacccttgcatctccatacggcgcaagcatagatttaacatattcaggtagcccgcgaatctgcgccccagctccagtaatgactatatttttcagaacgagggcctgatcctccgggggaaccacacacaacacagcaccaatacgctcagcaatctcagcgaacggcgattcgcatgcggcccgaacctgctcagttacatcacagcgaacagcctttccggcagatcgaaactcgcaggctgctaccagttgaggccgcccgacaaatgcaaattgttctttaaccatgcgcgcaatgttggcatttatctgcagagcaggatatcgctccagaatggaattctttaagcgttcatcaatgtaacttccagctttagctatagagctctggtcttctgggcgtggaattcggcctttcatggcgcatatatctgttgtccaagcccctatatcaataataattgagccactagctttgccgatgctatttccagccaaaaaaggggctgacattaaaagcacattctggcagtactcttgggccagcttgagtaagagctttttgttcgccgctgtgaatcgaggcgtcacaccgataacagcaaaaactttctcaccagcagcaggctctgcacacttgataatatgactgataaagtgcctagtgacatcgatgtcttgctcactgataggatttaacaatccatccagcaagggattccgcagatggaggtaggagcgcatttcgaaggcttcatcaccaacaagatacgggcgcccaagccgggctaagccaacaaaatccttcgggtaccccaccaacgacttcaatgataatgacttacctcgactcgtcataatgacagtctttgagtaaccaaaatcgataccgacatagagtatgttttggttatcgttcacaatcatcatgctgtccccgaatctagctggcgttcaagatcatatttgacggaagacatcgttgcaaacgctgacctgaaccgccccaggatcgccggaggcttgttggttaaccctggtcggtgttgaaaatctccggcctgccgaagcgggcgagagcctcctgcaaggcgtcgatgcagaaatcggcctccatggtgttgggtcgtgtcccgccgagttctctaatcgcggttgtcacccccctcacttacgtcaccgccggactcatggctcacccagcgcaacggctactttgctgcggctcgcaactcgtagtgcagcccggtcatgggcggaaaagtcatcaaatccctccttaactgctctcctcactttttgaaaatggcattcctgcttttcataattcgtctaaagaaggcagccccttgggctgacaaacttccagctgccactcccacaagatctgcaatacctgtagttaaaccctgtaccggcacgtcagagcggaccggcgtcgggctaaccaattccttttgtacatcctcaatccgagcactatcccgatcccgcgcggagcgcccaggtacgacaggccatgctccagaaaggtaattagggctgctgtaagatgatgattcattccgattgccattgggatcaacgtcaacccgcactatacattcatcgtgctcagttcctttcgcaattctgctaacaacctcgatccaattcatccatgaattaatattgtcatggaattgaaagaacccgattacggtagagtctggcccatatgccatgacattagcgtgttcaatatgaagagttacgccatgcgctttgcattgaaccttcgtgattgactgaatatctttagcgtttactccgacgctcagcccttgcaaagcgacatcaatggcagagccatgccgttcatatccatcacggcattgccaatagacctcgattgaaccaagcggagcagcaacgaacaacaaaaattgaaattcaccatcgatcacgccagatgtgcgggtaagcaacttttggcgcagcaactctgcctcgctaatgatctcctgaactttcccatcaatgaattcagcaaccatgtggtcggagagtgagacttccgactcatcctcggcctcgatctccaacagatcaacggatctcgggagataaaccactgcagttggctctgaaggcagaacctcctccggcgcctccatagcgggcgcaagaagagctgttcctacctcgggctgctcagggatagggtctgcagacggcagtatggtcgcattaggtaccggtggcagagtctgccctagagattctgacgacttcaaggctgggatcattgctgccgcccgtgcaccggggaccggaataaccggaggtttggtacggatgactggtgcttcaaccttctgttggggcggatgtgaagcggcagcggtaacaactgcagactgacgtgccgcctgagccgccttttgtccagccagcttacgacgcctctggaaaaagacataaaatccgacaccgccgacaactaccaaggcaaccagcaccatgatgggggcagatgtcggtcgatcctgagattttctcggatcgggcagttgcttttcgatgctgggctgcggactaataagctgaacctcatgcgggggggggggggcagcttcaaccgaagcatttggttgaagctgaacttgaggtgcctgaggttgctgggagccaagtaaggtcttcgcttcacgaagcggttctgaatcgtgcgatgcagatccctccaaggttccgttaatttctgaaatggagcccaaggcttcgacagcacgatttttatgatcggcaggaaggggttcccgaacgatctcactagatttctgttgaagtacccccatggccgtcaacagctggaccgaaggattctcaccaagcgcaacacgaagggggagatatttcgctcctgaagccgctgcccaatcttgaagatattgagagttaccggaaatgtcccaaattatcagccgcgccccaatcgcacgggcaacgcgtggcatcaaatgatcaataatgtctacattgcgttcattatataactgcccaacagagttatagagatcgacaatagattcattgccaatatccgacctctcttgcccttgcccttgcccttgcccttgccaaatttcataaaaatcccagttaaggtcatcgtatcttttgtctttttgaaccttttggcttaaatagccccgattgacatcccaaacctccggttcaccgtcggaaatgatgatggcaagcttggttgctggccttgcatgcttaacaagatattgaaacggcagttccaggtccgtcgcgagcccgtcagctttcagcttcccaaaagaggcattgatgtcggagtggtcaataccttcatcagtgtctaatgataagagattgtgtaactcctcatcaaaagcgactacattaatcttgtatgaatttgagaatgtttttaaaaacgtctgaacccaggctttcgacgccatctttgggtcgtgcctatttacagatcctgacttatcaaaaagaacaataatgtcggcatcttggcgtgcattcgcacttcctgctacaaaaatcgcagcaagtgcgtaaaatacaacagcaatccccccccctcgaattaccactacgttcctccgtgatcgacctactcgagcttagaaaggattattgctcgcttctctgctaagaattgtgcgatttcagactccgccataatctttttttcagcggcaaaggcgctaaaataatctttaatgttattaagttcagcgtcaactttttcaactagccgcttctgtgcatcactggcgtccgccttgtatgtttcattaaactggcgctctagccgtgccctctcatcctcagaccaagccattatatttcgaatagcatcttctttttgtgcttctataaactcattgatataagactgatttttcgattgcccatccgttgactggctagctagcatggaaatatctaattctaattctctttgacgagcgataaggctatcgatatttttccttaatgtggcctcctctttgtggagctcagcaactactgatctgcgttcatcaataaatttattggtgctagagttaggtcggccacttgatttaggtgatgaatgtctggatgattttccgaataaaaaattatctgaagcgaagatgcttttgaacgatttttgcgtcgaagctatcgcggcagtcagcttccaacctgtaatccagtcaaaaattgtcagtgttacataaaataacgctgaagttatgactatgagtacgaccagttcaatcatcatcccctccactgccataggcttactattttatggctacggcatcattcaggtagcacttacatcaagggcattcgcggccatccatcagtgagcaccatatcaacatgtcctggttaatggatttccggcactttcctcacatctagatatcgcattttagtgttttgaatgcgatctgttaccccacccgataacacatgaatcagatttgagcaatcggctcatcaggtcgagagtggttctaacaactattatcacagtgccggggtgtctttaagcaccccgaaatacccccgaccaaaatcagtgcgacgccccctcagttaaccggacagcagtgatgcgcacgccagtatttagtggtgacgcaggagttcaacgagagagatcgtcgcgatactttctgatcatagacagccttaaagaatcaaaatcaatgaagcttgtactgtacgaatcgatgccatacccttacaaaaactgggatttaacccatcatggccgctattggggatgctccatgagttcaagtgatgctattagcaagctgaaaaaggcacaatctgcttttaaagacggcggtatcggcacagctaagaggccgtccggaaggttcttgaatcaggtgaatcggttatgattccatgggtctccagagaaatgctgggggcgccatgtggaccaaggacaaccgacggctctatgagcggagcggacttcgctatccaagtgatctgacggatgaggaatggtcgctggtggcgccgctgatcccaccggcaaagcgcggcgggcgccagcgaacggtggatcttcgtgaagtggtgaatgggatcttctacgtgttgatgaccggttgccagtggcgagcattgcccacggacctgccgcccaaaagcacggtgcatgaatatcttgggctgtgggaatgggatggcacgctggcacgcctccatcacgccctgttcatcgaggtgcgggaactctccggcaaagaagccagcccgacggcggcgatcatagacagccagagcgtcaagggcgcggaaaaaggggggcgcggattgatccatcgggctacgacgctgggaagaaggtcaaaggcaagaagcggcacatcgtcgtcgatacgcttggcttgatcctcgcggctcatgtccaaccggccgatgtccaggatcgtgatggcggattgccggtcctcaaggaggtccggcgcctcttccccttcatcgttcgggtgttcgctgatggcggctaccagggggccgccaccgcggcagccgtccgcgcactcggggcgtggcacctggaaatcgtcaaacgctccgacaccgccaaggggttcgaagttctgccaaagcggtggatcgttgagcgcaccttcgggtggctggggcgttgtcgccgtctcgccaaggacttcgagaatctcgccaggatggcgctggcgtttcttcgcctcgccatgatccgcctcatgctgcgaaggatagcaagacaccggaaatcataggaaacttcacggacggactctaagctaaaatcagcaggtgccgcgatcggaaagaccggttctaaggccgcgacgctaggtggtggggcagcgaagggcgcgcctgccagtcttgccgttggcaagttgagtattccttatatgcccctcaccgggcttggcactggatcgatcaaagttacgtcagtgggtgttgccaacggctctaaactcgcttccatactgatctcgggaaaagggttgagcctcggtttgggtttgggtcttggcgctttggggccggcattagtcgcgggcacaatctgcgctgcaggctattgtgcatttcagagatacggaggaagcccgaaggggaaagttgccagtaatctgggcggcattcttactaaattctctgcgttagcagattcgatttatgacgcggggcagggcacattcataatgcagcctggtcgccccaatgcaaaggcgcaccaacgattgactgaatcaggcgatctgggggcgcttttctccaaggtagcctcgatagtggacgcagtttattcctccagcgccaacaagattagaaagctgatttctgagccggatgatgaggcggccttggcggcagagttagccaccgaaatcgccatggctgcgaagctgcttgctgaggcgaatgaagctgaaaagcgagctctggttgcaggggccagcgccaagcaggctgccatgctagctgcagcggccaagcgaagagccaaagccgcattggatttacagcatcaaactgaagacaagcttgccgccactcgtgcgaggaaaaagagagccgcagctgagcagggatcggaataaacgcgaggttcgcatgtttaagattcattccaggatgcatcagtgcaatccgacgccgccctgtgataatagttctcagtattacgttctacggcgggcggaaagattcatctggacagaatcatcctatctgtaagaaaatgcaatcttgcaatgatgtctcttttatagcttgacgtataatgatgatgtctgcagaaaaatcacccgcaaccgcttcagccggtttgcatcacagtaagggggccgaagcatgcttgaccaagtgatcatggccaaggttgaagggaccactcaggcagcactcctgtcctcaatgaccggaaattcctacacagttgggcaagtgactgcagccggaaatggcatgggccactggttattccttaaccctgccgacgccgccgccgctggaaagggtgccgtcgcgctcaagctggaaggtgcccgtcaggttgctcagctctccagcatggtaggcaataccgtgacgatcggaaatgctcccatggttgcgggtggagccagtaaatggctcgtgatgctccctaaagctggcttggctgccaagggagctgctgccgctgcagtcggtgccggaggggcggctgttgctgcggctcaaggcggtggcaatgcgggtatggtcatgatgcagcttgaaggtgccaatcaggctttccagttgccgatgatcactggcaagacctttacggttgccaaaacgactgctgttggaaatgaagcagctaattggctctttcttcagccggttggcgacaccgccaataccatcaaggacttggttgtggtcaaggttcagcatggtgctggccaggtgcagtggctggtcggcaagaccttcaccatcggcgaatccccgattatggccggcaccactaacaagttcctcgttctgaaccctgtgaccggagccgccgcgaagggcgctgcaggctctgctgttgcagccaagggggccatgcagaccgtggcgttccaggccgccggtaaaaccgctgtggctggaaccgccgcgaagggtgcggctgctggtgcggcggcttctgccgcaggcaagactgcggcagtcggcactctgtggactggcacgggcatgagccttggcctcggtcttggtctcggcgctgctgggccggttattctcggtgggctgatcgcggcggctggctacggcatctaccgctaccgcaagaaccaggctgcctctatggccactgaagttgacgaagccatttcggacgcagtaacggcttagtctgaaatcagttccggtttgatgactgaatctcggcggtggctaactaaggatttagccgccgccggaatcggcggcatacagtgcgaagtcgttaacgaaaatgttgagctgaaggaggtatcaacaggatgcccccccctcctacactgcaagctttgccggaagctggttaaagtgtgccaaggtaatttagcgcgtaacgcgggtaatttggcctgtgcctttgccattatttctctgatagatccaatcattgatggccccaccggggaccgcgatgggaaatgtttcattctctcacatcattgtgaatgggatgggaggccgtggccgccccatatgcagtccccctctaccaatgtagaacatacggaggacgcccgatgatcacctccaccataactggatccaaaattgctgccgctgccgctcccggtgttggaaaggctacagtctttatcctcagtgcaacgatgggaattggtgtgctggttggcctgtccttggtcactgctgccggaggtttctacgtctgccgtaagctttgcggcgtggccgcaccaattacataagccccctctgggatgctgaggtgttccatggatgaggaggagttggagaggattgctttaaaaattgttaccgcgtggacacggtgcaatgctgaaaacggcgcagacacgccgtctttgattgtatcaattacaaatcaaatgagggtgatattggagccgattgaagaaaatataggtcttgttagatatgttggaaaactctcggacagcagatataatgcgggtagaattcgcatcagatactgtcagtcttgtggccatatattcaaagaaaaagctcattacgtaagcatatgaatttttgcacagatactcttgcagtctattgcgattaaccccgccccaattccagtcgattatgcgccccgtccagcgaagctgtttggcgagcatggcctgtgacccaccgattaggccgacgacgcctttatgacccggctgttgaagaaaaatcggtaggcggccttggtgttcgcccagtcctgacaagctcggggaatagcttgtccaatggcgccgcccagctgatcgaagtatccgtccggcgacgaccaccttgccgtcagggctatgatgctgccagctttggcaccggtgcaagcaccattgtttgcaccggtgccaggagatgttgggtggcgcaggttcatgttctgaccggtccggagcgacggcggcgctggagtgctgagcagaagcgggcaatcgtggcggcggcgttcgcccccggcgcgatcgtcgcggaggtggcccgacgggcggatgtgtgcgccggtcagatctaccgctggcgccaggatctgcgtgggcatgcccaggaattcgccgaggtaatgatggtgccggtcggggatcagtcggccgtgcgctcgggctcggatgcggtaatcgaggtgcgcttggcgagcggcgcgggcgtccgcattcccgcgacggcgacgccgggtttggcatcggcgatcatcaaggcgctggccgggcgatgatcccgatccccagtggggtccgggtctggctggcgaccgggcacaccgacatgcaccggggcttcgacggcctggcgctgttggtgcaggagcggttgtcgcgcgacccgcattccggccacctgttcgtgtttcgtggtcggcgcggtgatctgatcaaggtgctgtggtgggatggacagggcctgtgcctgttcgccaagcggctggagcggggccgcttcctgtggccgtcgccggccgatggggcagtgaccatcaccccggcccaactcggctacctgctggaagggattgattggcggatgccgcagaaaacctggcatccgagcgccgccggctgaggaaatcgctgttcaagagcgctggattttgattcactttcggggtgaccaataccgccgaagcccttccccgtgaccttgccgccgcccatgcgatgatcctcgccgagcgggcggcgcggctggccgccgagtcggatcggcgggtgttggacatcgagatcgagcggctcaagttggagatcgcccggctccggcgcgagcgcttcggccagtcggccgagcgcagcacccgcatcgagcagcttgaactgtccttggaggatctggaggagaccgccgccgcggtcgaagccgccgccgagacggctgaggtgcaggcccatccccgctctaagccggcgcggcgcctgttgcccgagcatctgccccgtgtccgggtggtcgagccgtcaccgtcggcgtgtccctgctgcggtggcaagctgcacaaactgggcgaggacatcaccgagacgctggagcgcatcccggccaagtggcgggtgatccagcatgtgcgggagaaattcacctgccggagctgcgaggcgatcacccagccgccggcgccgttccatcccatcgcgcgcggccgggccggcgccaatctgctggccgaggtggtgttcgcgaaattcggcctgcacctgccgctacaccgccagagcgcgagcttcgcccgcgagggcgtcgagatcgacgtctccaccctggccgactgggtcggcgcggtgagcgtggcgctgaaaccgctggtcgaggccatcgctgaccatgcccaggcgggcccgcgcgttcatgtggacgacacgccggtgccggtgctggcgccgcgcgcgcaggcgcgctcggatcaaacaatggcggcgaagccggatggcaagacgaagaccggccgattatggaccatggtccgtgatgaccgcccgttcggcggcaatgatccgccggccgcagcctatttctactcgcccgaccgcagtggcgagcatgccgaaggattccttaccggcttcagcggcatcatgcaggccgacgccttctccggcttcgggcggctgtaccagcagggcgccatcgtcgaggcggcgtgctgggcgcacggacgacggaagttcttcgatctggcccagttgaagaaggcccccatcgccatcgaggcggtgaagcgcatcgacgccctgttcgccatcgagcgcgacatcgccggcctatcgcccgaggcgcggctgactgcgcgggccgggctatcccgaccgctggtggacgatctggcggtatggctgcaccagaagcgggccggccgggcaagtcggataccgccaaggccatggattatctgctgaagcgctggccggccttcaccctgttcctcgaagacggccgcgtcgatctctccaacaatgcggcggaacgggccttgcgcggcatcgccgtcggccggcgcaactggaccttcgccggctccgacgccggtggccgtcgcgccgccgccatgtacaccctgatcgagaccgccaagctcaacggcgtcgatccgcgcgcctggctggccgatgtgctggcgcgtctgcccggccattccgcccggcggatcggcgacctgctgccctggaactggaaaggcgaaagccatgccgaagctgcatgacctggaggcggatatggaggcgctcgacgaattcctgatgtcggatcagtccccgccagactgtatgatgttgtgcgatcttgacggctttctgaccggcatcgccatcgggccggacctgatcatgcccagtgaatggctgccggtcatctggggcggcgaggaaccggtgttcgacgatgccgcccaggctcaggccatcatcggcatcatcatgacgcgatacaatgagatcatcggccagatcgccgatggagccgtcgctcccatcatcatggaaacaccgggtgccctcgcaggctcggcaggaataggcgggccggatgtggcggatcacctgaaagcggccggggacgtaatcgaggatctcggtgacgtcttcgccgaccttgcgcatcgctccgccgcaggacgggcaggtacaggcgctgtcgtggaccacctcggtgcgcggcaggtgtgacggcagcggccgccgggcacgattgcgcttcggcgcggggccgtcgctcgcaccttcctcggcttgcgccaagacgtcggcggcactcgattcgacatcctccagcatcagctccaactgatcggcggcgcggctgattttctccgacgagcggccgaactgcatccggcgcaaacgggccagctcgatccgcagcttctccacctccagcgtcttgctcatcaggccggcctgggcggcggccaacgcatccgcctgggtggcgatgatggcctgtagcgcgacgatatcggtgggcagggcgtctggaaccatgccgtcgattctaccgtcagaagcagattccgaccagcgccagcccctcattttgtgaggattcccgccgggtgtggcgggaatgactcaccccgccgattgcggcttccaggtgcggatcggcatcctccagtcgatcccctccagcagcatgccgagttgcgccggagtcagcccgacgatgccgtccgccggcgacggccagacgaagccgcccttctccaggcgcttggaaaataggcaaagaccttggccgtcccaccacagcaccttgatcagatcgccccgccgcccccggaacacgaagacctggccgccgaagggatcgcgagacagcttcgcctgcaccagcatagccagcccgtcaaaacctttgcgcatgtcagtgtgcccggcagccaaccacacccgcgtcgatgtcggcggcacgatcatcccagcgccgccagtacccggcgtaacggctcggtcgccacctccggccccacccggatcatcacgccagtgggcagcacgatttcgatccgcccgctatcgtccggcaccacagccgggggctccgaaaccgcgatcgccagaaaaccaccatcagcgatcccagtagcggccgccagcaactcccgccgccaagtgaacaactgctgtggcgcgatcccatggcgccgggccacgctggacactgtccggtccggcatcgccgactccgccaccatctgctgcttgtccgccgcactccaacgccgacggcgctgaaccgacgtgatcacctcgacctgggtcatcgtgccacgcattaaagtcaccataatgcttggcacttggcctcaactcgccccgccgcacaaggcagccgtcagaggacggttacgtcgcggacgaccactgaaagaccgaagcgccgatccaaaccggctggacgcgtccatgatctcggagatgaagggccttgaggacgagaaccggaggacgacgacaaggcagccgtctgaggacgcttacgcaaaccgtgcaatcgctctttctcatctttcactcattccatttgctccgcgcccgatgaggcgaagctcaacgcttgatgaccatgctttttccaggtgccttgagctttcgctgcctgaagacattcatcagaaccgaaacgatgccggtggcaaaaccgagaaaaaacgtaatgccaaggattacgaaatgtggcgcaatcatcgccaatgggctcaaacgggtttctaccatgtgcgcgttggacgaggctaacagcacgatcaacccgccaattactagaaatccaactagggcttgttgagattcaggattcacaagatggacgaaacgtgattcaagctccttgaaggagtttgtcatggttcgattgtgtttgacggatactcaatgggcaaagatggaaccgcattgtctgggtaagccgaccgatccgggtcgcaccggggcagatggacggctgtttcttgaggcggtactttggattgcgcggacgagcagcccctggcgagatttgccccctgttttcggcaagtggaacacggtattcaagcgctatcgggactgggtaaaggccgatatcttcaagaagatttttgatgcggtgtcggatgaccccgacatggaatacgccatggtcgatgccacgattgtaaaagtccaccgtcacggtcagggcgcaaaagggggactcagaatcaggccatcggcaagtccaaaggtggcatgacaaccaagattctggccctgaccgacgccttgggcaatctggttcgcttcgttttgctcccaggccagcgttataccaagtcccggtagtcagcgcctatgggcccattcgcggagcccgatggacatgatggtccagggctgatcgatcagcttgttccaggcatggcagcaatggtcgacgatatcttcgtaggattggaagatccggttcgacagccagttatcgcgcatgaactgccagatgttttcgaccgggttcaactctgggcattttggcggcaagggcagcaagcagggtgatgttgtcggggaccgtcagctcggcggagagatgccatcctgcctgatccaccaggagcacggcatgggcgcccggtgcgacggcgcgcgagacttcctccagatgcaggaccatagcggctgtgttgcaaagcggcaggaccagaccggccccctttcccaaagccgggcagattgcgccgaacagatagaccgacttggttctctgatccttgggagccgacctgccgatcaagtacgccctcggccgcatcgccaatcaacgcaatgccgtcagggcccgcctcgccaagaagaaggaagggcaatccggctgaccaaaatcagcccgcgcccgcggtcttcaccggacggatacacgaaaggcgcctctcgacattgatctcgaaatgtacaagtggcggcatctcatcgagaatttcttctgcaaactcaaagagtttaagcgtatcgccatgcgcgcggacaaaacagaccagagcttcgcggccatgatctatctcgccgcagccgtcatcaattccagatgaatctcaacaagccctagatttagcatgcctatgtcctagagaagtggcacctcaacggtcgtgagattttgaacgagtacagaacgttgcgatgagcatgcaaatcatcaataatcatcaattgcgctgcaacgacgacgccggaatctggacaaactggcaagctttcccttgatggaatgcatcactaggcggcctttgtccgagattatgccgctaaaattttcacgattactaactaagtcaccagttacatgcgcagccgatttggctaaattgaaaacaccggcgtaaaaactctcgacgggaacttctttaatactgacacatgggggggcagccagggtctcctcacttgtaatttggattactgaggacttatgcccatagtacaatgctgacggtggcaaagagctttctacagcctcaattgccatttcggttctcgagtcagcaaccaagagcttatccaaaaattccatttcagagccaggcttaacccaatcgggtatctgaaccagcccgacgctcccttcaatcttgattgcctcaaggccatgaggcggttctgaatcagaggggctcgcagggttggtctcggcatcaatgggggctatatctactttctgtgagatcgcaacctcttcattgagcgggtctctctcatgcgtgggcagagaaattcccattagctctgctacggctggttcaggttgtggcttccccccgctatcggcaactaaattggctagcttaggcagatcgccttcatctaggtcatcaacagagtggatctctgcggcagccatcatgctgttggaggaacctagtatttcaggggggggcgcatcgttcacctcactggtaacagcagccagtagagatgaaagtgggctaattaggggcaaagcagactctggttgggacgctaagctgacgtcactctcatggggagtcttaacctcaatgaatgtgctttcttcgcggattggctgggagacggcggtcggctggataagcggtaaccagggcgttccctcattggcagctaatgcggtatcagaagaccatggagatgcttccagcaacgctttccatttatcactctctggagtttgagcgccttgccccacagactctggcacttcatgcgtgggcaatgtatcgctcaaactcttggggtgcgggacagtctttcttgacgtttttcgatttttggcagtcatttccaacatcgtccttacagaacaacccacacttctcggccgctacggttgaccctcagcaaaacctccggccctgccgtcttcgcggccttgatggccgcatcaagaagggcgggggtcgtcacaggcatgttgttgacctcgaggatgaggtcattcggcattactccggcagcctcggctcgagacccagttgccatttcagccacttgggcccctgtggttttgattgggggctcatcgggagatcctgacatcatcggctgctccataaagccatcaatctccatgcccatccaagtgaactctgtcggaattttaggtggtttggccggctttgcaggggcggctggttgaactacgttattatttcccgcgccagcattctgcttcggcgcaggtggagccgcagcagtcggtccgacaagcaaagtcaggttgctgacactgccttctcggagtatgccaagtcgcaccgaacgcccgtttggcatttcagagatgattgcaattacttcacgtgccgagtttaccgggcggccgtcgaccttgagcagcatgtctccagcctgcaacccggccgcagcagctggtgtattggggctaacaccggtgataaacaccccccgcccagccggcacgttaatctgcccccccatcagctgagacattgggggcataaatgcgccaagcagattatgatttgggtaggtttcccgagcagcctgacctccgcggggaaccttgacattcattgctaggcttccggggggctgagcaaactgatacccacccaatccaggctgtccaatggcgactgagccggatacagctccaataatttgatggcagttgacgcagttcatgctttgccggccatcagtgtgaggattggcggcattggcctggattggcggcccagattgctgctgcgccacgatgggcatcgactgaacaaatgcgatgggaccggccgaggctccgacgatctgatggcagctggcgcagttcatgctttgccggccatcagtgtggggattggcggcattggcctggatcgacggaccagctggctgccccgcaactatgggtatcatcggctgagtaaaagcgacccggccagcaggtgcaccgatgatctgatgacaggtattgcaggccatgttctgtcgaccgtcggtatgaggcggagtggcgattgcccggatcggcggcggcaaacggggattggctacgggcatcagcgatccagctgccgccacacctggatttgaggggagtatctcatgacaattggcgcagtcgagattttggcggccgtcagtgtgaggtgacgacattctggccataatggggggacccgctgaaccaactccgatgcgggacggtccttgaagggcgaccaagcccattgaagggccttcggctgtcgtggttggtagccatcccacaacttcctgagcaaactgccgggcttgattgctcggcacagcaaaaccaatgccggaaaacgcgccattcggagtatagatggcagtattgatgccaatcacagtgccattggcaatgaccagcggcccgccagaattgccttggttgattgctgcgtcagtttgcagcagctttgagtgggttaccccctcaatcaccatggatttattcttggccgagatgatcccgcggctgacagacatatctaggccgaagggcgttcctatggcgatcacctcgtccgcgacaagcacagcatcactgttccccaggaccgccaccgacagctgggccttcggggtgatttttaggagggcgaggtcaagggcttcgtctaacttgacgatctccgccgaatatcgagttgaacctgtgtcatccggcacggtaacaaaaacggattgagcaccacggacaacatggaaatttgttatgataaaaccttcatccctgacgattacaccagtaccgacgctgtcaacaaagctggcagaagggttcgcgaatcgcggcgtcgtcgattgatgatccagcgcaaaattcccaagcgctggctgtctgctgggtgacgatgctttaacactaacaatgccgttacgtaaaagagcggcaacgttggaaaaaccgccgccactgctagctagggctcgtggcaccccccccgtgttgggctgcagtctggcaacagcaccaggttgagtcggcagattgacactactcccatgtccaagttgctcaagtatgctttcaagtcgaagccccccagaaggctgccgatagatgaaggcgccaaacaggacaattagggcgatcacacccatcagcatcaagtaacgcttgagttccttgctgcgagtggcattagagtgtccctcatcatctgcgctacgattgaacattgtttcaatcaccaatatcagagtcagatctggtcatattaagggaagaaggcaacctcttagtcaaaagacctgaggccaatgcaatcagaccaaaaacgattaatgccaccggcgtagttctactgtgtcataaaacaagccattgtggtagcaatggagattcggtctgctcaataggggggtgagcatgggtctccatggaaaggctggcgatagtgaatcgcgatttgaggcgtatgtcgagggcctttgccgttcggttcgccatgccgaccgggcggcgccgttgcgggcgtattgcctcgggttgatgctgccgggcgaccgcaagagcgtcgagccgatggcggcgcgggtcgagccgggacgggtgcaggcggcgcaccagtcgatgcatcacttcgtcgccaaggccgagtggtccgacgaggcgatgcttgcggcggtacgggcgacggtgctgccggcgatcacccggcatggccggctccgcgcctggattatcgacgacaccggccttcccaagaagggcgttcattcggtgggtgtagcgcggcagtattgcggccaactcggcaagcaagacaattgccaggtggcggtgacgctatcgatcgccaatgatcacgccagcctgccgatcgcctatcgcctttatctgccagaagactgggcctcggacccggcgcggcgccacaaggcgggggtgccggacgaggtcatgttccacaccaagccgcagatcgcgctggagcaggtccgcgccgccctggccgagggcgtggcgcccggagtgctgttggccgatgccggatacggcgtcgataccgcctttcgcaccggcttgtcccggctcggcctgacttacgtcgtcggcattcagtcctccaccagcttatggaagccgggcgaggcgccattgccgcccaagccgtggagcggcaggggacgaccaccctcactggtccgccacgaccccgagcataagccggtttcggccaaggagatggcgaccgccttgccgcccacggcgtggcgcacggtgacttggcgcgaggggaccaacaccctgctgagttcacgctttgccgccgtccgggtgcgccccgcccaccgcgacaccttgcgctccgagcccaggcccgaagaatggttcttggtcgagtggcccgaggaagacgccgaaccgaccaagtactggttctccaccctgcccgccgacataccgctgaccaatctcgtcgagatcaccaaattgcgctggcgcatcgagcgcgattttcaaaatctcaagcaggaacttggccttggccactatgagggccgagggtggcgaggattccaccaccacgcagccctctgcgtcgccgcctacggattcctcatcatcgagaggagtctgattcccccctcgggactttgctccgccccgatccgccaagcgcctgccctacccgacggttaccgaccccgaggatccgcccgttcggcctgagcgccacgtgacaacgtcgatcacaacgatacggctgagactgacacgggcgcttacccgacgattaccacggtgcccctgctgccagcggccgacaccccagatcctcatgcttatgacacagtagaagtagcacctcggagaaattccgttaccgaccaccaccaagccgttgccccgaacaagccaacggtcagcgcaattaggcccaaaattacgctaggcataaaacatctcccacagtgcctttgatcataaattccaatatccttagcacaaatttctcggcgaatcagtggttcttcggggccgcaggtgacccaggtggacggactgagagtctgaccggcaccaaggccggcgtcatcatgtcgagctcaccttgagcctgtaggctcgacccggcaatctgccgcctgttcgtcgtcgatggtgccaaggcgctgaccaaagcgatccgcaataccttcggccgccataccccgatccagcgttgccaggtccacaaggcccgcaacatcacggattgtcttgccaagccccttcatgccagtgtccgcaaggctctgcggcaggcgtgggaactggatgatgccgacaaggccgagcgactgatccgaaacctcgcccgtcgcctggagcatgacgcgcccggcgtctctgccagcattctggaggggggcgacgaaatccttaccgtcaagcacgttggcacagagggttttgagacagcgttccgatcagtttaagcagccaacgtctccgagttttcaggcgggttgatccaggctccccgttgtatggggctggaaaaggaattgctcgtcacctcggcatcgccgggttgacggttgccgttgggctttatgggtattacaaagggcgctggctcggatccgttgatgcagcggccgcttgaaaaggggacatcatgaccacgcagactgtcaatctcacacagccacccggtgcggcgtacaagcccctggtaatggcagctctgagctatctgggcatcctttgcttcgtcccgcttatgcgatacagggatgaccagtatgtccagtttcacgcccgacaagggctggtgttatggatgtgggccgtcctctccctctttatcttggaggtaccggttatcgggaagtgggtctttggattttcgtccacactgatcctcgttctgtcggttgcgggtttggcttcggtcgcattccgtcgtgcatggaagttgcctctggtcgcgtatatcgccgaccgaatttgacattcgggctggatatcctgcgctatctcaacccggtgagagtcccggcgtcgcagttgacgcttaccctcctaatatattggcgatcaactcaatgtgctcaacgattacgcactggttgaagcagtgttcggggtgaaaggctttgcccgattgcttcatgcaagggtgcagagttcctggcgagtgccgtgctcatcgtgagcgccaagctcgctatttccagcattgcggatgattctgattggtcagcgtcagtttcaattaatccccccccccagccattccttgttcatggatacggctagggactaatccatatccgctgtaactccaggccctaaatgagtattcaattcagatatatttttcgagcagcggccgccatctcggttctgatggtgttttcgtttggactattgcgctacaatgaattcttatcaatgcgtgaggacgcacagtcaaagcggtctaacttcgaggttcagatacagaggcgtaacaatttattcggaaaccttattaaccttacaattaatcatgccgcacttgaggggtctgtattcgcacactcctcagataagcgcacagaattgattgatggtggcgtcaataaaaatgatatattgaagcttgatcatattttttctcgtgatggctttagtgttgcctttggcaagcttattgcctaccaggaaaggtatcctgacattaagtcagtaaaatcatataaatttatgatgtcgtctcttgtcgaaatggaagaaagaatcgcgaataatagggttctgtacaatgaaagcgccgctaaattcaatgcggaaatccgaaagatgccttggaattatctcgctatgattactggcttcaaggagcgggagtattttcatcaaggccaagaaagcacggcgatcatcaatgctcccattgtcgcaccagagatgtaccagcagctgatgcctttggttcctacccaagaaattgataagaagtaagggtaagtatcttctgcccgacgaatttctctcggagcttgggttcggtgcaggtccgcgccacgcctctgttccaacgtgcttgcgacagattgatatgtgccgtttagtgacggggcatgagagtgatgatgaagccgataacggcacttgcagttgatggggcgttgtctttcgctcgcatcaccgcatcaacatactaaaagcaataattattattacacaaagagaataaatagcgaaaatgagacaatccattgataatcttcgagcaaaaatccatgctctgcgagcaaaaaccattgcaaacgggtgtacagaggcagaagctttagctgcggccgagaaggttgcggatctattggatagaaatgaaatttctatttatgatgttgatgtctttaattcgcaatgcgggaagcttgttatagagaccgggagaaaaacaaagacgccgatctcggcctgcatcggagagatcgccctctattgtaactgcaaagtttgggcagaaaaacgcgaagatggggtgcggtatataatattcggccttaatgacagcattgaagccgccaactacgtacacgatatagttttaaaatatcttggcaagatgtggggtgattacaaagattccaataaactagttggtaatttgcgcagccaaaaaagttcgtatcaatttgggatggccgtttcgattgcacataaattgaataaacttaaatcaattcgcgatgaaaacaatcgcggaacaggtggctctgacctagtactagctcgtcacgctattgtggaggccgagtttgcaaagctccagataaatcttcggcgcggaaaggttttgggaaagaaggttttcttgggagtttttggggccggtcaagtggcggggcaatctctgaccttgcatgaaggtgtccaggataaagaatacgttccttaggatatcaaccagtctgattgtatttccatttggcagacagatggaggtaccatgcaccgtcctaaatagctacttaaggccatcgaaaatcgtagcgagccgaccctcatgatatggagtatcgtaacatggggttgacagtcaccacggtacccggcagctgatatcaagtccagttgactctttttccagtgcatggcccatgaaaattattacctttgcatcacaaaagggcggtgtgtccaagactaccacagcgttctgcgttgcagcagatctcgcgcgacgcggtgggcgtgtcgctgccatagattctgactctcaagggtcattggcactgtgggcaaaaggacgcccggtagatcgcccacaaattcctgttgccgctgtcagcccacaaaacctcaaggctgccattgatgtggctcgcaaagatcgatacgattggcttgtgattgatacaccgcctacgggggcacccctagaggtcgagaccgcctacaagcattcagatctcatagtgattcctgtaacgccatccgcaatcgacattgcagcaagtggcgtgacggttaaactcgcccgtcagctgcggcgaccgtttatcattctgatatcattggcagaccccaagctgtctggaatgtttgagcgctcttgggtcgcggaagcgagaagggagctaaatcagttcggcacattgtatcctggctgcatcgtcaaacgcagagcgtatcagcgggcctttatgaatgggctcggcgtttctgaaatgggcgatgatgcagccgcacaacgtgagatttcccaactgacagactggattattaggcaggtaaatagcgaggcagtcgcctaattgtccctacctcgaaatcgagtgcactgacgcaaacacaggattcacaagcgacctgcgctgtgcgtgcgaatctgtggtcatggcacagaccgtcagcatcatcgtctcccccgaggaacaagtgcgtttggccgaggtcattggggatcgcaacactccgcaaaagcagtattcccccggtgacggccgctttttcaggctgaccgtgctctgagattctgcctgtctgattggcgttggtggacggatgtgtccacaaattcggttatgcacagacagaagttctgtagttcggcgccgcaaccggtcgtggccagaggcgctgaaaggggagatcgttgcggcgacgttggaacctggggtggggcttcggtcgcggtagtgggtttccctccgccgagggccgcctgttcggccgagctggtttgaggcatgctgatgacgtgatcactcgcagcgaccagggccgcgactgccgcgacgccatcctcggcctcgccaagacctgccgcaagctcggcatctcgttctgggatttcctgggggaccggcaccgcctcggcgccgctgtcggaaacgccgtgctgggactcccctcgctgatcgcggccggcgcgctacgccgcctgatcgcccggacttttgccccagttaccatcagcattagcaactgattgatattaaagcagagaaggttcatctgtagcctcctcctccccgccatcttcccctgatgtgggtcttcctgcaaaacaaagccaggccttgacctgttcctgaccttgttgccgttcagggatggagccccttttgggccggggctttccgcaggcttctggtgagccacaggccgggatgcgggggtatctttcgatgcccggcgtctgtcaatcttcccaaattgattttgtgattgccgggaatgaggtagtctcggcgcatggggatgatccgcttgctcttggcgatatgcgttgtggctgggcactcgagaggctttttcggggcgccgctcatgggggggggcacggccgtccaaatcttctacgtaatctcgggcttctacatcaccctggtcttaaacgagaaataccgcgagcgggtgcggcttttctattcgaaccgcctgctcaggctggttccgtcgtacatgatcgtcctgcttcttgccgtcatcgcgctggcagtcttcgggcgctcgactcacgcgagcgttgatgagtggcgagccatgttcggacaagccgatctattcgccacgctctattacatctgggtgaatatcgggatgcttggaagcgaccaagccctattcacctatctcactccggatggctcgctcggttggacggcagacttccgcccccacgccctggcgagctaccgcttccttctcgtcccgcagtcgtggtctatcggggttgagctgctcttctacgcggtggcgccgtttgtcgtgacgcgcagcccgcgcctcatcatcggcttgatggtggtgtcctatgccgccagatggtcggcctacgccaatgggtttgcgttcgacccatggacctaccgcttctttccctttgaactcggaacttttttcgccggagcgctggcggcgaggtttcgccaaggccttgagcggaacggcgggtggcttctgcttgcggtttgggtcgccaccatcgggacttatgcggcgacggccacggtgacgatggtcggtcccgttatggacatcgtcatacgagagacggccttgacctgggggatggctttctcccttcccgccatctatgccctgagtaagtcgaatggcgttgaccggtttgcgggtgccttgtcctaccccctgtatatctgccatcacttcgtgattctggccgtggctgcgaccagtggtgccgatgggctgggaggcgtgaaaagtatgacggttctcgctatcgctctggcggtttccgtggtcctcgccgtattcgtcgaaatccctgtggatcggtggaggcaaaatcgtgcgttgggcaatccggagatgaaggcctaatcaaggcaatccgcatttctgacgctcgccaggacaagcgatctccatgcctccactcccaatggcgtccagccccttcaaaacgtcacagacttcggccggtgtggtgaagtcgatacggggatggcggaacggaacccactggaagcgctgatagaaggttcggccgggatggggcggcattgaatagtcgtaggccgcctgagggcgcagtgcttcgtggtcgcagcggacatagtccaggttaccgcgctcgctgccataggcggcaagctgctgccgcttgcggccttgttcctcctgcgtcagcgtgacgatggtgccggattcagaatcgatgaagcgctggctgttgatccggcttccggcgaagttgtagagcggtgcttcgaacaccgacacctgatggcgaaagcctgcggccaggaagctggcgacgtcgtggtcctgatgtccaccctcataggcgggaacccacatcgatgccggccgaaggcggagcagggcgtcggccacggcttgtcgggcgatggcaaaatcatccttcagcctgcgggtgggaatgggaagagggccaatggcttcggcgccgagaagcttcgccgccgcatgggcttcggcggtcctggtggcgaccctgagggtccgccgcccccgctgccacggccagagcagttcggccgccggaatgccgtcggtcagccacaaaatggcgatgcgcgtcccggtctcgcgggcccgcccgatcaaggccgagaagcccacgacctcgtcatccggatggggggcgaggaccaggacggactcggtcatgaccggcaggcggcttccagggtccgtcccatggcgaccgcttgggattcctgcacggcggcgcgccagaccggcagcagatcctccgccagtacctgctcccaactgggcagggcctggtcggtactggcggtgaccgccatgcgcatggcggcaagccggctggggtcgctggccagggtctcgaggatttcggcccaggcggtggccgagctgtcacgcaccacctcgccggtccggcccggctggacgaactcgcccatgccgccggcggcggaaaccaccaccggcagacccgaggccagtccttccaggacgacgttgctgatttcctcgatctccgacggcatgaccagcaggtcggcacaggcataaacccgcgacaggtcctcctcggccaactgccctgggcaactgacccaagcgccgagccgtccgacgatggcagcccgctcgcgcccatcgccggcgcaaagcaggtgaaggccgacgccccgcccgttgacccggcgaacggcctcgaccaggggcgtgaggttcttgctggggtccagccggccgacgaacagggcgacgggcatggtctcgggcacgccgaagcgggcggcaagccacgcacggtcgcgtttgcccgggttgaagacctgacggttgaggccgcgccgcagcatccggacacgctccggggacaggatcttggcagcccgctgggcttcgtcagtcttggagaccagggcataggcgcagcgggactgatgcgcggcgaggcgatccagtttggattgcttgaaccgattgggcaggtccaggcgctcggtcagcaggcggcccagccatccggtgccgcaaatcttgcggatgctttgctcggtgaacagccgggtcagctccggcgtggccgtatgcacggaattggtcatgggcaagccggtgcgcgccgatatccgctcggcggtccgggaaaaggcgaagaaggcgtcggtggtgtgtatggcgtcaaagcgcccctcgctcaggcggcgagccagcagggggtgccagggggaaaggtcggtatggtcaggcagtggcccggtcagcgcctgcagccgcttggtgctgaagacgggcggcagggtgacgtagcgaacgttgggtcccagatcggtggttcgctccgcctcgcctgacaggaagaccgtgaggtccaggctgtcgggaaggccgagggcggcttgggccaggcgctcccagcacttgacgtggccgccggcgccttggcgctgctccaagtcgaccagggccgccacggacagggggagcgtgggggtcaatgcggccgctccgtcgccagaaggctcctgattccccggcgttcaatgaatagccagaccagcagccccggagcacagaccacgatttcgcgggtgcgcttggccagggccagggccagggccgattcggccggcagtccgaggagaaggcctaccgccacgattcccccttcctgggcgccgatggcgccggggatcaggaaggcgatgctgcggaccgcccaggccaggctttccagcgccagggccgtctccagggtggcgggaagtcccagggccgccaggagaatccaggactcggccacatgggccagccagccggccagccgccagccgaaaccggccagcatccgcggtcgctgtcccaggagcaaagccacttcacggtcgagatcggcggcgccccgggccaggcgggaggcggtctcctcgcccatcaatctcttcacgacgcctgacaggccggtgaagaaccccttgcgctgcaacccggccagcaacccggccagcagtatcaggatcgcggttccggccagaacctgcaggctggcggcgatgccgggggcgctcagcagcagggcggccacgcccatcagggcgaatgccgcctgagatgccatgcccagcaggaaatccacagccacctgcgccccggccgcctcggtcctgacgccgcccgaggtcatcaggcgagcccgggccacgtcgccaccgacctgtcccaccggcaacagggtgttgatggactcgccgatccagcgcatgaccagcatggccccaaagccgggccggtccgcggctggcacgacggcgcgccatcctagagtgtgggcggcaataggcaaggcacggtaggcgcaaatggctacgatggccgggccgagggaggagaaagcgtctccaaggcgacctgcatcctgagccagcgtcaaggtcaccaggccgcctaccccgaggatggcagcaatgaaaagctgtgcgcgcatggtgacaggtgctgacccaaatccagtttgggcgggctggtcgcccgccataggaggtaagatagagtatcgtttggtccctgagaagtgcggcgccgtatctcgccttcatgcctccaatgcgtcagcggcggaaaacaaaccggcgctgacgttgacgcttgcggcaggcgacggacaggctaagccccatcaggccaacgacaatccaggcaggcatgtcgagaatggcggcggtcagggaactggtcgccgatcggccggcatcggtgatgtcgggggcgtgaccggcgagcagggtaaccacgtcggcggtcacgatgctggcatattccgccggccccaaggccagcacggcgtcggccgacgccatgatcacggcgaggccgaccagcagccaccccatcacacgcccgaagaacatctatgcccccgacgattaacgcccttatctcacggataaatacagatttgcgccgaagctgtatgaaattcaaccgtttttcggtgacgaacaacgattctcttggggggttgcacccatcccggagctcgtgtatcttcccgcccttccccgaacccggcgagccgggttcgtgtgttgcggaggggtggccgagtggttgaaggcgcacgcctggaaagtgtgtatacggtgttgagccgtatcgagggttcgaatccctctccctccgccaacttctcaagaccctgaaaaatccaatcatttcagcgacttagagaaggtgcgcttggcgtttccaccaacgctttccaccaacgtttcgggcctcgaaaacgacagatgacccccgccagtttcccggcaggagccaccttggttgctcaccagttggcgacaacccgactgtcttcggcatagctgttgcgcttgccgccaacgaacaggttggtgggcttctgggtgccctcggcatggccgatgaccacagcctcgcccgatccatcacggatggcatcgaacagcttgtaagcctcggtcgtgtccatggtcacccggtttcccttggtgtcggtgaaggagacggtgccaaaggcggaacggtgcaggacggtcttgcccgcgattacggtttcagaattgctcatcaggttcttcctcgaaggtgttggggacttcctcggcacggcgggcaatggcccgaaggaccaccacttgaccggggaagggcatggagaaatcacggcgaggggtcacgccggggggaagccggaaggacagtagctctcggttcaagagcattccttcgggcatgggtacaacgatgcgagacaccacaggcccccactctgccgggggttcccaggtgctacgcaggacacggggatagaggtagtcggggttgcggagccgccaacaggcaagctctgccttggtcatcctcgagaacttgccgatccaccggcaccacctccagcgagatcagataggaccagtacccacgaacctcggacaggatgcgctgaatggtcttggccttcttctgctcctgggatgcaaggcgattgacccaccgctgaacgtccttgcccttcacgtccgagacataggggaactcctcggcaaagcgcaggacggtggccctcttcatgtccttggtcttggcctcgttggtgagggtggcgacccattcatcaagatgggtgtccagtttcaccagcctgccggtggcaacagcctcgaagcggtatgcctcctgcacctcggggaggtccatcgcgccctcttcgcggtagtcggtgaacccagcccgatccaacgcccgctccacccgctcccgccgttcctcggcaatggcctccaaggtcatgtcccgatactcttcgggggtggtgagaagggtcttgcgccagaactcggcatccttctccaggtgttcccgtccgcccttcctggcctcttcgatcaaagccagccaagaggacttgaggggggccgctctccgttctgccgtcttccggtcttcggtctgaagggtctgggtgaagcgggcatgaccacccagagcctctcgcacatcggcagggatgtcatggaaggcataccaaacgcggcgacgtcgttccagatacacagccagcccctttccaccaacgtttcccaccaacgaataccgctgtgagtggctgatatcaagggttatgccgagttgataggtggcgctcggagcgtccctctccctccgccattctgatcaaaaaggccaccctcgggtggcctttggcatttgaacaggtgcgggaggcggggcggctatagcgcccgggcgagccaatccttctcggccgtatcgaaggcatcgttgatgaaggcgtcgacccggcgcatgtccggtttgtgctccttggcggggataaggtagttccagtaggcggggtcgcagggatattcggtgatcaccaatccgatcccgagccgcacgcattcgatcttgatctcttcaaggacgtcctgcagcccattggccgagcggctgtccaccgggtcgtcataaaagaacaagagaccgtaatgggaggcgcgagtctgtgccaaggcctcatagacggcagaaacatcgaactgctttgccgcgtgcttggcctcgacggtgaccagctccaactggctgttgggggcatgcaggaacttgtgcacgcacagcatggcaaaatcgggattgctccattttccggggagccttcccttatgggtcggcttggtcttctgcatggtgacgccatggcggccataaacgttctgccggacccagtcttcgatattgttctcgatatgcccgtatgtttgcttctcgtcggtaattccacccgtcagggtcaatccgccgccacggccggggcggatggcatagatgccgtcggcgttgatgtcggcaatgaccttgttcaccgtggtctcggaccagtccagggcctgggcgaccgtggcggggctgggggcgcggctgcggttcggccgagccagatagcggatcaaagaggtcttttgcatctggggttccattgcaatttcggtaaaacgcaggtttagacaaacacctcaggtggctttggattgtaaatctatcgcaaaaagggcggatgcatttcaggtttgacgtgtcgtccgcgccttttgcatgtcgtccccgattgagggacaatgcctcccatgactcaggtcttcaccattccgcccggcgcggccttcgtcgacaccttggccgcccagttgctggccgaggcggggggcgatccgctggccctggccgatatggagatcctgctgccgacgcggcgggcctgccgggccatgagcgacgccttcctgcgcctgtcgggggggcggccgttgctgttgccccggctgcggccgttgggcgacatggacgaggaggaactggagctgtcgggggccgatccgctggacctgccgccggcggtcagccccaccgagcgggttctgatcctggcccgcctcatcctgaccgccgcccaggcccagaaggggcatgtgcccagcccggaccaggcggtgcggctggcctcggaactggccaagctgctggacgcggtgcaggtggagcgcctggacttcgccgggctggccaagctggtccccgaggattatgccgaccactggcaattgaccttgaaattcctgaccatcctgaccgaggcctggccgcgcatcctggccgagcgtggcacgcttgatcccgaggaccgcctgaaccgggtgatggcggcgcagatcgaggcgtggcgggtccggccgccccgccacaaggtgattgccgccgggtccaccggctcgcgccccgccaccgccgatctgctggcggcggtggccgcgctgcccgccgggcgggtggtgctggccgggctggaccgcgccatggacgaggcatcctgggcggcgctcgatcccgctcatccgcaatacggcctgaaggccctgctggcccggctgggggtggagcggcatggggtgcggccgctgacgtcggatgtggatctgcgccaggaccgggtgcgcctgctggccgaggcgctgcgccccgccgccacctgcgaggcctggcgcgacctgcccgccctcgacgccagagtgctggacggtgtctggcgcctggaggcgcccacgccccgcgaggaggcgggagccatcgccctgatgatgcggcgcgaattggaccgccccggccacaccgccgccctggtgacccccgatcgcgggttggcccggcgggtggcgggcgagctggagcgctggggtatccgcatcgacgattccgccggacggccgctggggctgaacgagccgggcgccttcctgcgtctggccgtcgagatggtggccgacgagttctcgccccacgcgctgctggcctgtctcaagcatcccctggcggcggggggcatggagaccggcgcgttccgcgccctggtccgccggctggagcgccttaacctgcgcggcccgcgcccggctcccggcgtggcgggcttgcgtcaggcggtgaaggaccggcgcctgtcctcgtggctggccgatctggagaccatggcggcgcctctggccgaccggctgaaggcagacgagggaagtctggccgacctgctgcgcgcccatatggaattcgccgaatggctggccggcgatgacctgttgcccggcccggcccggctgtggcggggagaggcgggcgaagccgccgcccggttcgccgccgatctggccgccgcagcgcccgccctgggcgacctggccgggcactgctaccccgccttattcgacgagctgatgggggccgtggcggtgcgctcggcctgggaccaccatccccgcctgttcatctgggggccgctggaggcccgcctgcagcacgccgacctgctgattttggggggactcaacgagggcacctggcccgccccgcccgaagccgatccctggatgagccgccccatgcaggccgctttcggcctggcgccgcccgagcgccgcatcggcctgtcggcccacgacttcgcccagggctttgccgcgccccgcgtggtgctgagccgctcgtcccgggtggacggcacccccaccgtgccgtcgcgttggctgatgcgcctcgatgcggtgatgaagggaagcggtctggcctttgaccaggatgcgggacagtggctggactggcacgccctgctggatcgcccggaacgctggacgcggcccgagattccggcccccgcgccgccggtttccgcccggccccggcgcctgtcggtgaccgagatcgagacctggatgcgcgacccctatgccatctacgccaagcatgtgctgcggctgcgggcgctggaccccatcgacgccgatccgggggcggccgagtacggcagcatggtgcacgaggcgctggaactgttcctcgaggcctggccgcgcgatcttcccggcgatccccagggggaattgctgcgcatcgggcgcgaggtgttcgaggccaaggtcacctcgcccgccctgtgggccttctggtggccgcgcttcgactccgtggcgcgctgggtggcggccaaggaggtggcgcggcgtcccggcgtggcccgagtccatgccgaggcggggggcgccctggagatcgaggcgccggccggtcccttcaccctgaccgccaaggccgatcgcctggatgagatgaaggacggcactctggcgctgatcgactacaagaccggcacgccgccccgggcccgggaggtggcggccggcttcgcgccgcaattgccgctggaggcggtgatcgcccgtcatggcggctttggcggcgtcagggcggccgaggtgtcggaattgctgtactggcagctcaagggcggcgcccagggcggcgaggaacgcgcggctggcggtgatgccgccaccctggccgccgaggcgctggaaggcctgcatgccctggtcgcggtgttcgacgatccggcgacgccctatgcggcgcggccccatcccgagcatgcgccgaaatattccgattacctgcatctggcccgggtgcgggaatgggccagcggcggcgacggcgaggaatagccggtctgccaccccctttcgaagagggggcattgagactatcttcaagaacaagcgaggcggcaaagccgtccgaaccagaaaaaacggtacaggaaggccacccaagcgccgtccaagagcgcccctggccgaaaacgccattgggaggaaccagggatgaaaatcagccgccgtcaggcgctcgcggggctcgcgggtgcgcctgcccttctttcgttcggccgcactgggtttgcccagccggccgccaccacgctcaagatctcgcatcagttccccggaggcaccatcgaacagggcgacttccgcgaccgcctgtgccgcctcttcgcccgcgaggtggaaaagcgcaccaatggggcgctgaaattcgagatctacgccaattcctcgctgatgaagaccaacgcccagttctcagccatgcgcaagggcgcgctggacatgtcgctgtatcccctgccctatgccggcggcgagttgcatgcctgcaatctgggcctgatgccctgcctggtcaccagctacgagcagggtgcccgctggaagggcgctcccatcggcaaggcgctgtccaagatccttgaagacaagggcatcaagttcatcgcctgggtctggcaggcggggggcatcgcctcgcgccggaatccggtcctgggacccgccgacgtcaagggcctgaccatccggggcgggtcgcgggaaacggacatgatgttcgccgccgccggggccagggtctccaccatgccctccaacgagatctatatcggcatgcagaccagcgcgctggatgccgccgtcacctcgtccaccagcctgatctcgttccggctggaggaattggccaaatcgctgacggcggcgcgcaagggctcgttctggttcatgctggagccgctgctgatgtccaaggcggtgttcgattccctgcccgccgcccagcagcaggtgctgctggaggtgggggccgagatggaagcctggggcaccgccgaggcccacagggacgacgaccaggtggccgccgtctatggcgccaagggctgccaggtgacggatttctccgcagatcatctggcccagtggcgcaagatcgccgaggaaagcgcctgggcggactatgccgccaaatcggccgaggcggccgaactgctcaagctggcccgggatgtaagctgagatgtcgggcggggctcagcacgacgccatcctcgccactgacaccctgcccgccgtgacggttcgaaacccggtcatcgccgtgttcgaagccgtcatggagggcgccttcaagctctcggcgctggccctgctggccgccgccggggtgctgaccttcggggtggtcatggggcatctcaccgggcgcggcctgctgtggcaggacgaggtcaccgtcttcctgatctcgggggccgtcttcctgtcggcggccagcgtccaggcgcggcgcggccatgtggccatcgactttctcgaccacgcctttccctacgccaaggacctgcgccacgcggtggtggaggcggggattctggccttctgtctgatctttgcctggaagtcgggaatgctgctggccgaggcggtgcacgagggccagacgtcgcaatcggcctgggggccgcccctgtggattccctattcggtgctgaccctgggcatggcgttgctggcgctgcaggtgatgctgcaggtggggcggcgatcgctctggctgctggccgtggtggtggcgggcgtggccgccttcctgctggccacgccgccggtcaagccgctggtgtccggcctgccccactggctgaccggcatcgcctatgccaccgtcaccctgctggtgatgttctcgggcatgcccatcgccttcgcccttggtgtggtggcgctgatcttcatgctgctgttcatgccggcggcgtcggtggacaccatcgcccagaacttctacgaggaactggccaacgtcatcatcctggccattccgctgttcatcctgaagggcgccaccatcggccggtccaatgcgggcaaggatctttattccgccctgcatgcctggctgcaccgcattcccggcgggctgggggtggccaataccatcgcctgcgggttgttcgccgccatggccggctcgtcgcccgccacctgctcggccatcggctcggcgggaatccccgagatgcgggccaggggctattcgccgggcttcgccgccggcatcatcgccgccggcggcacgctgggcatcctgctgccgccctcggtgaccatgctgctctatgccgtggccgccgaggtgtcgctggggcggctgttcctggccgggatcggccccggcctgctgttgatcaccctgttcgccggctattccgtcctgcgctatcgccacgaataccggcgggcggagcgggcggcggccagtcacggcacccattccgccttgctggccgacgagcattacaccacgagacagaagatccgcatggtggtctgggtggcgcccttcgtcaccatcctggctggcgtgatggtggtgctgtatgccggctgggccacgccttcggagaccgcgggcgtgggcgccgtgctggctctgctggtcatcggcctgatgtacggcatctggcggccccggctgctgatgcccatcctgactggcaccttgcgcgagtccaccatgctgctgatgatcatcggcatgtcgctgctctacgcctatgtgatgagccatctccgcatctcgcaggcggcggcggactggatcattggcctggcgctgtccaaatggttcctgctggcggccatcctgctgtttaccgtggtgctgggattctttttgccgccggtgtccatcatcctgatgaccgcgcccatcatcctgccgccgctgaaagccgccggcttcgatctcatctggttcggggtggtgatgaccgtggtgatggagatggggctgattcacccgccggtggggctgaacatcttcgtcatcaagaacatcgcccccgacattccgctgcgggacatcatctgggggacgctgcccttcgtgctgatcatgatggtggcggtggtggcgtgctgcctgattccgggcatcgccacctggctgccgggagcggtgatggggtgagggcgccgcggtgatcggttccgatcaccgcggcgcggccctacgccacgctcatggcgtagatggtcatggcggcgtagatgacgatggcggcgatcatggccccgatgctgagccgcgtgttccagaccttggccacgtccttcttgccggccgattgcagggtctggatgaagatgatgttgaagatcatcgagaccacgaaggcataggccaccaggaaatagtaatcggcgctcatggtgtagccgaccttgggaaacgagttcttctgcgacatgtgatagaccagcacaccgatcaggccggagatggtggcgttgatgcgcggggcgaactggtccagcggcacccacaagatgatgaggatgatgcccaggatgatgagcagcggcaggaagaaggtgaagaggtaaggcttcaggattctcttgatgccgatctccaggttgacggtggagaagtagatcgggctcttgtagccggtccccatgcggtaatcgggatcgccgaaggtggaatcatagcggtacaggtccgaaaagacgctgcgcccggtataggtccattcctgcggcttgatgtccttgaccggcaccgtctccatgtggcgggtgtcgggcaccaacatgatgtgggtggagttcttgttggtgtgggcgacctccagcggcagggtctgggaatcgaacgggaagttcgacaggtcgtagggcgcggtcagggtcaggcgcttgcggtaggcgcggtacttggtgccgtgggacaggtcttccttgaagatggccgactgttccttgaccgcgttgatggcggtgatcttctcgatgtccttgacgtcgagacggccgccggcccacttgaaccacatgaagaggtccacgtcccactgcatgtccttgatgctgacatcgttgatgcggatcacgtcgatgccgaccgagatcacgtcgacgatgtggtagggggtgccgtccaccagggtcacctggcccttgccgatgcgctcgcccatctccttcagcacgtattcctcgtgcgggatcaggagctggaccggggcggtcttgaagcggccgtccttcatcaccgagacatagacgtcgcggtacgaggcctggacgatggcgccctggtccggccgcggcggcgcggtctcgcccttggcctgcaggtacttgcccacgtattcggcggtcatgtcccggccgttcttgaagaacaggttgccggtcacgccttcgacgaagccgtgccattcgatgccggccacgtagtcgcggaccgaggcgcgggtcgccccgcccttggccccgtcgccctcggccgccagaatggccttgctgatcaattccagagaatcgaaggacatggctgcggccaccgtgggacggccgccaaagcgcttgccgtaggcattggcgaaggtcgaggccttctggttggcgatttcccacaggaaggccgaggcgaggtagacgttggccgtgtacttctcgtcaatctcggtgaggaatttcgggttcgaccaggtgttgggcgccatgaccggagccttgatcccggcctcgcgcagctggggcaggaaggacaggccggactcggaatgggtcagggtggcgacgatgccgaaggactggttctcggcggcatcggcgagattggtggcggcccaatccttggcgacggggcccacggccacgggcagggtcttttgcaccttgaggcccaggcgctgggctttggcgaggaaggcgtcgcgcagggcggtgccgaaggggtcggtgttgtggaccaccaggatattgtccttcttcaggacctccttgatgtagaccgccaggaactcgccctggacggtgtccggcaggttcagggtgaacatccacttgttgccggcaaaggccgccgggctgctgacattgggggacaggaaggggatcttggcatcggcgaagatcttgccggtggccagggccacgccgggatagtaatgcccgaccacggcgatcaggccttcgtccttcaccatctcggcggcggcggcctgcgccttttccggatcgtcgaaatcgtcgcgcaccaccagttccaggcggttgccgttggcttcggcgctcttgttgaactggtcgacgaacagttcggcagcattcttgaggggaatgcccttttccgtcgccggcccggtcaagggaaccagcacgccgatcttgtaggtcttcgcatcggccgcatggggcagcagggcgaagacaagggcgaagagaaggctcgagataaaacgcattctgtagatctccctggccttacgcggctttggtcttcaaggccgagccgaccagatcctcgccgaaaatatcgggagcctttccggtggcggtgaacatatagaccccggccaggaagatgatccccaggaccgaggacaccagcatgacgaggccgagatagacggcgccgatgccgaccaggattcccagataggcctgggccgcatcctgggcgagatagaccaggccaccgaccagggctccggggatcaggatggccagcagggtcagcaggccgagcatggactgcccgcccagcacgtcgccccagtgagtcttgatcagatgggtggagcgccgcacggcgtcgatggggccaacgccctcgaccaccaggacgggaagggcgaaataactggcggccagccacaatccgtaaagaccggcggtcagcagcttgaccacgaaggcgacgatggccccgaactccttgcgggccagccgggtcagcgtctcgccgatgatccgcaggatcaggccgatggtcccggcgatcagcgcccacaaaaagatgggcagggcgcggcggccggcggcggccagcccttcgccgatcgtggtgctgccggtctcgaaatagcggatcgagcagaagatcagggcggcattgaagaacagcatggcgaaatagcaggcgatatagccaccgaaggccgtcacgaggacgagaatgtcggtggtgttctcatccgcattgccggcgctgaacaccgccagaagcggcagggtcagggcgatgatgcccagcatggccgccgccgagcagatgggcaggatcatcagcttcggctgggcgcgcagaacgcccagactggccttggcgatatgccacccacggaaaaaactgttcatgcctcgtccccccccaaaaaaaatcgcgatgtctccaccggccccccggcgcgaggatgcgttattcggccgccggctggtgctgggcgtgcgccggggcatggccgtgaccatggccatggctgccgtgcggcgacgtttccatcagcttgttcaggtagcccagcatcaccgccgacacgatgaacagggtgtggatgatgcactgccacatgacgacggtttcctgcatgtggtgttcggcgttgacgaaggtcttcagcaggtggatcgaggagatgccgatcagcgccatggccagtttggtcttcatggtgttggcattcacgtggctcagccattcagggcagtccgggtgcccctccacgcgcaagcgcgagacgaaggtctcgtagccgccgatgatcaccatgatcagcaggttcgagatcatcaccacgtcgatcagacccaggaccagcagcacggcggcgctttcgtccatggcgggatggtggaagatctcggcgatttccaggaagaaccggtagacgtaataggtctgggcgacgatcaaccccatgtagaggggggcctgaagccagcggctcaggaagaccaggcgggcgatgccgcgcgtgaacgaatcctggccggcatggccgtacatctggtggctcatcgtaactcctgtctttccgcgccatccgggctaaccggatggccattcccgccaattcggacgaagagtaccgctatcaaaggggatcggaaagtacgaatgaccgagggctatgtcattggggagaggacgcaggtcgcctgattacaggtatattacatgctttatttttcgacgccgggatgcagggccagggactggcccgccgtctggccggcctggaaggccgaggcttcgactttcttgcccgatgcccggcctcggcgaagattgaggttcagcttttcatattcggcgtcgacgacggcgtgacggaccaccaccaggtcccggccggagcttcgccggttggcctcgtcccgctcgtccttcatggcgatcagcttctcggcgatggacacggccatgccgaactggaacgagcttttttcatcccggcgatgatgaatgaagcgctggctgcggacatagtggtcccagccgccccgcatggcggccatgaccacgtcgtagacgtaatgggccatctcgatgccggggcgcagcccgaagaagacatagcggatgccggcctcgtccttttccagccagaccttgcagtcgcaataggcggcgatggcgggaacgcaggcggagatgggctggcgctgcttgcgcctggtgtcgatgaccgccctctcgcactgctcctcgcggatgtccagatcgctgaccgacaggtcatgctggtcgagaagctcggcgaccttggcggcggccgccagggcttcctcctcggtgcagccgttggcggtggtcttggcccgcagggcctgcagccgcgccttcagcttgtccaggtcggtggccacggggggctcagcccgccgccagacgtgccagagccaccgctccctcgcgggaccgcgcgccgcagacgaaccgggcgggatggcagaaggtggcgtcggcgatgccggtcagggcggcgaaggcctcgtcgcgcaggccgccccagctctcgggcagggggtggcgctgggcgaaggacccgcgttccggcggcacggcgctgcaggtccaggccgctcccgccgggcgcaccacgtaaagggcccggtccagtcccaggtcatggatggcgtcctcccacgggaccctggtgtcgaggacgatgatcctggcatcgccagcgccggcggcggcctgggccacggtggtttccgcctgaaccgaggccgaagcccgggcacaggcccgctccagcaccagggcggcaatgtcggcggcctgcaggaaggcggcgttctcgtcgcgcccatcctcgacgaaggtggcgttgaaggcctcgatgacggtggagaagtgaccgggcgtgggcgtcatggcgccgttgtccatcaggtccacgtcgcggaccagaccggtatccaccttggcgaccacccgggcgacggcgtccgccgccagccccggcagcagcgtgccgatcgcggccgctccgaagtcccgccagaccaagcccgccgagctgtagggctcgccattggggcgcaacggtttgtcgcgcatgtgatggtcatagcgacgggtgccgggatcgtagagtccgcccacgtcgaacaccaccgccgccgcgtcccagtcctgctgatcgcgcgaccgggccagttcgatccggccaccgcaggaggcgcgcagaatggcgaaggcaaagacgtcgtcggcgtgaaacgtgccgttatgggtggcgaccttcagcattgcgggctctcggttgatggttcggggcggaaaacgaaaaaggcggctgatgccgccccctgacccacggaaatgaaatggtgccccaggccggactcgaaccagcacgccgttgccggcaacagattttgagtctgccgcgtctaccattccgccactggggcaccgcaagaatggtggcgggatcatagcgagtgcggaggggcggtcaacggatttccgttggccgcccctctggctgttcctacacgctgaaatatttggcctggggatgcacggtgacgatggccgaggtggattgctcgggctcgagctggaattcctcggacagcgtcacgccgatgcgctcggcgcccagcagggacagcaactgggtctggtcctcgatgcgcgggcaggcgggatagccgaacgagaagcgcgagccgcgatagttctgcttcagcagcctgtccatgtcggcggcgtcctcggcggcgaagcccagttccgagcggatgcgcttgtggacgtattcggccatggcctcggccatctccaccgacaggccgtgcaggtagaggtaatcctggtacttgtcggccttgaaccagtcctgggccacctcggtggcgcgcttgcccatggtcaccacctgcaggccgatgacatccctgaccgggtcggatacgggccggaagaagtcggcgatgcacagaccgccgtccttggcctgacgcgggaaggggaaacgggccacctccgtggtgccgtcctcggcgaacagcaccacggaatcattgtcgctggccgccttccagtagccgtagaccgcctggggccgcaggatttcctccttggcgcagcgcttgagcatgtccatggcgacgggacggatctccttatgcgcccaggccttgaactcctcgatgctcttgccctgcttccgatagccccagtggaactggtagagcatggtctcgttgaggaaggggatcaggttctgcagcggcgccgactcgatcacccgggcgccccagaacggcggcacgggggcgggaacatccttgtgcagctcggcgcggcgcaggttgatctcgtcccaatccaccggacgggtggcgggctgggccgcctcgcccagggtacgggacggcgaaccggggcggtgtgggctggccgccttggccgccacatgggcgtcgaaagagccatcggccaccttggccatcaggtccaggccgtcgaaggcgtcgcgggcataggccacccggcccgagccataggccttggagcaatcctcctccacgtatttgcgggtcagcgccgcaccgcccagcaggacgggcacgtccaggccggcattggtcatctcctccaggttctcgcgcatgatcaccgtggacttgaccagcaggccggacatgccgacggcgtcggccttgtgttccttggccgccttgatgatctcggccaccggctgcttgatgccgatattgatcaccttgtagccgttgttggtcaggatgatgtccaccaggttcttgccgatgtcgtggacgtcgcccttcaccgtggccagcaccatggtggctttctgctgcccgtcggccttttccatgtggggttcgaggaaggccaccgaggccttcatggtctcggccgattgcagcacgaagggcagctgcatcttgcccgagccgaacagctcgcccaccaccttcatgccgtcgagcagcagggtgttgatgatgtccagcggcttccagccctcttccatcacctgggcgaggtcgtcctccagcccggtgcggtcgccgtcgatgatgcgctgcttcaggcggtcctcggccttggccgggcgctccttcttgatctcggcggccttgcggtcgccgaacagggcgatgtagcgcgacagcgcctgcgggtcgcggtcatagatcaggtcctcggcggccttgacctcttcctcgggcagggtgtgcagcggcacgatcttggagacgtggacgatggcgcccgtcatgccgcgcttgatggcgtggtcgatgaacaccgagttcagcacctggcgcgccgccggcttcaggccgaacgagacgttggacaggcccagcacgatgccgcattcgggcatctcgcgggtgatcatctcgatggcgtccagggtctctaccgccagcttgcggtcgtcctcgttgccggtgcagatggtgaaggtcaggggatcgaacagcaggtcactggcgggcaggccgtgcttggtcaccgcgaagtcgtacaggcgcttggcgatgcgcagcttggcggccgcgtccttggccatgccgtcttcatcgatggtcagtgccaccacggcggcgccgaacttgcgggccaggaccagccggtcggcggcgtccttctcgccattctcgaaattgatggagttgaggatggccttgccgccatagagcttgagaccggcttccagcaccggcaactcggtggaatcgatcaccagcggcgtggtgacggcaccgcgcagacggctcaccacctcggtcatgtcggcgacctcgttgcggccgacgaaggcggtgcagacgtccagagtatggctgccttccttgacctgctcgcgggcgatggcggtgatgccgtcccagtcctcggcgtcctgcaggtcacggaacttcttcgagccgttggcgttgcagcgctcgccgatggacaggaaggcgttctcctggcgcagcggcacctgggtgtagagcgaggccaccgagggcacccagtggacggagcgcttcaccggattggggcggtacccgttgccgatgcgcttcagcatctcgttggtggcgctgatatgcggcggggtggtgccgcagcagccgcccagcagattggcaccggcggacacgaagcgctcgtgccacaccgccagttcggcgggcagcaggggatagcgggtctggccgtccaccagttccggcagtccggcattgggctggatcgagacgaagccggtccagttgtcgatcagccacttgaagtgctcgcccatctcctgcggcccggcggcgcagttgaggcccatcagcggcacgccgaggctttgcaccaccgtggcggcggcggcgatgtcggcgcccaccagcagggtgccggtggtttccaccgtcacctggacgaagacgggaacgtcggtgccggccgcggcattggcgatcttgcagccgttgacggcggccttgatctgcagcgggtcctggcaggtctccaccaggaaggcggaaacaccgccggcgatctggcccgccgcctggatgacataggctgcctccagctcgtcatagccgatatggcccaggctgggcagcttggtgcccggcccgatggcgccgaggacgaagcgggtgcggccgtcgcccttgaactgttcggcggcttcccaggccagctcgatggccgcctggttcagttcgtgggcgcgctcggcgatgccgaattcggccagggtgatgggcgaggcgccgaaggtgtcggcctccaccatgtcggcgcccgcctcgaagtaccgggcgtggatgccccggatcacgtcgggccgcgacttgaccaggatctcggtgcagttctccagcccttggaaatccttctccacggacaggttcatggcctgcaccagggcgccggtgccgccgtcgcacagcaggacatgtcgggagagatggtcgagaatattggtcatcggtcgttcctttgatgccgtcatgcccagacttgatccgggcatccatggatcgccgggtcaagcccggcgatgacgagaaaaactagccggccgccttcggccgcacgcccaggatgtggctgatggcataggccaggtcggcgcggttcagggtgtagaagtggaactgctccaccccttcggcggccaggatgcggcactgctcggcggccatggtggcggccaccagtcgccgggtctccgggtcgtcgtccaggccctcgaacaggtcggccatccagccgggaatgctggcgccgcaggccgccgagaacttctgcacctgggcgaaattggtcaccggcaggatgccgggcaggatcggcacggtgatgcccgcctgggcggcgcgctcgcggaaggccaggaacaccgccgggtcgaagaagtactgactgatggcccgattggcgccggcgtcgatcttgcgcttcagattgtcgagatcgaactcggccgaaggggcatcgggatgcttctccgggtaggcggctacggaaatttcgaagtcggcgatgcgcttcaggcccgtgaccagatcggcggcataggcatagccctggggatgggcaacgtagggctggccatcgggcatgtcgccgcgcagggcgacgatgtggcggatgccctcgtcccagtagcgccgggcgatgtcgtccacctcgcccttggcgtggccgacgcaggtcaggtgggcggcgggcttgagcgccgtctcgcgggcgatgcgcaccacggtctcgtgggtgcgttcccgcgtggtgccgccggcgccataggtcaccgagacgaattgcggcgccaggggagccagccgctggatgcactcccacagcgaaacctgcatcttttcggtcttgggagggaagaactcgaaggagacgctgaccggcttgcggcaggcggtggcgatgggcaattcggggcgggggagactcaacgcgtcgctcctgtggacttggaatccggaaagggtttttgggcggtccagaccaccacggtcaagggttcgccgggaaggcgggtgacagggccgggctccagcccggcggcgcgcagccagccttccacctcggcatcctcgaaccccaggcggcggtgggcgtgctggtcgcgcaagctctcctcgccatggggggcgaagtcgacgacggccagccggccgccgggctccagcacgcgggcggcctcggccaccagggcggcggggtcggtggcgtagtgtagcacctgatgaatggtcaccgcgtcggcggtggcggcgggcaggggcatctgggcgatgtcgccctggcgcaccatgcagttgctgagggaaaggcgttcgagattggtgcgggcgacggagagcatctcacgcgacaggtcgatgccgatggcgcgttccacatgggggcccagcacctccagcacccggccggtgccggtacccatgtccaccagatcatgaatgcggcgcccggcgaacacggccagcagggccttttccacctcggccccgtccacctgcagcgagcggatctcattccagcgcgacgcgttgtcgcggaaataggcctgggccttgtcggcgcgtccggcgcggatggacgccagccgctggccatccagggtcagggtttgatcgtcgccgggcagcaggtccagcaggcggcgggccacggcgccgccccggcccttggcggccaggcgatagaacacccaggccccctcgggaaagcggtcgagcaatccggcctcgcacatcagcttcagatggcgcgagacgcgcggctggctctggcccaggatttgagtgatctcggtgacggtcagctcgccctgggcgagcaggtgcagcagccgaagcctggtcggctcggcggcggcccgcaatcccgtcagcaaggtttccattccagggggctcccgttcacactcgaaaaacatataaacatatctttatgcggatatgaagcattgattgcttgccaggcgaatctcgggtctttgccctatggtgcggatttgccacatgattcgccgtgtggaggctggattttcctttcccctctagccattagatcgggactgtgatacctcggaatattgggggggcaagtggctcctgacctcgggtgacgcctcggcgtgcccgttttcttattcgtaaggtacagaaggtacgcagcccatgaatgcctcgcgccggaccatcgcccgcctcgtcgctcctgttcttgccctggcgctggtcgccggttgcgcaacgccgccgcctgcggacgacaaggaggccgttgccgagtgggagcaggtcaatgatccgctggagcccatgaaccgggctgtcttcgaattcaacctggccgccgacaaatacgccatcaagccggcggccgaggggtatcgtgccgtcatgccgaagttcgggcgcgagcgggtgcacaatatcctgtccaacctgaacagcccgctggttttcgccaatgacctgcttcagggcgaggccgaccgcgccgtccagactttcttccgcgccatgctgaacagcaccttcggcctggccggctttatcgacgtcgccaccccggcggggatccccccgcatgaggaggacatcggccagaccctggcggtgtggggcgtgggcgaggggccgttcctgatgctgcccatcttcggaccgtccaatccccgtgatacggtgggcttggtggccgagatgttcgccgatcccttcgatctggccatggccaatatcggcagggaatacatcagctacgcccgcatgggcatgaccggcctggacaagcgcgaggatctgctcgacaccctggacgagattcagcggacgtcgctggactattacgcctcgctgcgttcgctgtatcgccagcatcgcgcgtccgagatcaagaacggccgcggcggcggggaaaagatcccggctccggggctttcgcgcacaaagagtggtgaagagctctcccaatcggcgcagtgacagagcataggccggaaaaagcaatgatttcgcgtcgttcccttatcgtcgtcctggccggggccttccttggcctcgggtccgattgcgccatttcggccgaggccgatcccaaggcttttgtcacccaactggcggccaaggccatggagaccatgacggtcaagggattgtccgatgccgagcgcaaccagcgcttccggacccagttcaccaccgaggtcgatctgtcggagatcggcaagttcgttctgggccgtcattggcgcaccgccactccggagcagcagcaggagttcctcaaggccttcgaggatatcgtggtcttgacctgggcgacccggttcaaggattacggcggcgacctgcgtcatgtggtgaccaacgtcgccgccgatggcgaccgtatcatcgtcgtcgattccaaggtcgagcgcgaccaccagacgcccatcaatcttcagtggaagctgaagaagggcgagctggatcttcgggtcgtcgatctggtggtcgaaggtgcctccatggccattacctaccgcaatgagtacgcggcggtgattcaatccaatggcggcaagatcgacgggcttctgggcgccttgcgaaccaagatcgccgagatgcaggcccccggcaaggacgccaccaagtccaactgagccctccgggcaattccagccagttccagactatcgaacgtcacatgtggcgggcgatggtctgttcatggttgccccttgccggggcgcaagccttcagcctgcttggctgctggcggagccagcgtcggacgtgaagcggacagccctagaacagagataccagactgtcgatctgggtcgtgctcatggcggccacctgggtcgcgttgaaggcgccggcctgggttgcgctcagagacagaatctgagtggtgctcagcgccatcacgctggcggtggcgatggaccccacctgagtggcggtcaggccgtcaatctgagtggtggtcaggcccgccacgttggtggacccaagggccgccaattgggtgatggtcaggctccccaactgggtagagctcaccgcgccgacctgggtggtggacaggccgccgattcccgtcgacgtcaatccccggacttgcaccgtggtgagtcccgcgacctgggtggtggacaggcccagcaactgggttgtgttgaaggtcgccaggctgctggcggtcagccccgagacctgtgtggtggtgaggctggacagcgaggtcgcggtcagcccggcggccgccgtggggtacaaggatcccagggcggtggccgtcaggctgccgagctgggtcgtcgacagaatcgacagatcggtagaatccaggccgcgggcctgggcggcggaaatattggccacctgggtggtggacagcaccccgacctgggtggtggtcagcgcggtgaggctggtcgcgttcagcgccgccatctgggtggtggtcagcgcgatgatttccgccgaggtcagtccggcgatctgggtggtggaaagggtcgcggcctgggctgcggtcaaccccgcgaactgggtggtggaaaggctggtcagggcggtcgtcgacaaccccatgatggacgtcgtggtgatcttggacagttgtgtggtggacaggcccgataattgggtgggagtcagggctcccaccgagagcgaactcaattgggcgattcccgtggtggtcagtgcgccgatgccggtggaatcgatgctggtcagctgggtggtggagagcgccgtcacggcccccaggctgagtccggtcacctgggtggtggtcagcgccgcgagagtcgtggttgacagcgcccggacctgggtcgaggtcatggatgccatctgggtggtcgacagcaccgagaattgggtggtggacaatgcaccgagattggtggtcgacaggcccttgacctgggtcgccgacagcgaggcgatccctgtggaggacaacccgttcagcaaggtggtggacagtcccgaaagctgggccgccaccaggcctcccaactgggtcgtggacaaggtggcaacggccgtggtggtcaggccgttgatctgggtcgcgctcagcgagccgagcatggaggtcgccagcccgcccacctgagtggtggtgagtgctccaagttccgtggtggtcagcccccgcacggccgtggccggaaccgcggccaactgggtggtggaaagctggaccacctgggtggtggtcagggcgccgacaccgctcacgctcatggccgcaatggtcgtggtggtcaatccggcaacctgggtggtggtcagcgccgccaccttggtggtggcaagggtggcgatagccgttgccttcaggctggaaatttgagtggtcgacagctctaccagcccggtggtggagagcgcgccgatctgggtggtggtcagagcgcccatctgggtcgtggtgaatgccgccagcccggtcgtattcagagtgctgatctgggtggtggtcaggcgtgctgtctgggtggcgctcagtgcggtcaactgggtggtggtgatggtgttcagttgagtggaactgagcgctccaaggccagcgagcgacaatccgcctatctgggtggtggtgaacaggccgaggctggtggttgaaaggccgggggcctggttggtggtcagcgccgccagctggaaggccccgatgccgctgatctgggtggtggacagggtgcccaggtcggtggtcgacaacgccgcgaaggacagagccgccaagctgcccaattgggtcgaggtcagcccgcccagttgcgtggtggtgagaaccgccgtcaccgtggggctcagccgggagatctgagtggtggcaagctgggccagaccagtggtgtcgaggatggccgcctgggtcgaggtcagcgccgccatctgggtgacggtcagggcattgacctgagtcgtggacaatgcggcgatggtggcggtgggcaggccgctgaactgggatgccgccagggccgcgaactgtgtggtggacaacgcggtaatctggctggaggccagtgcggcgatatcggtggtctcgagcccgagcatctgggtggtggtcaaggaacccaggtcggtggtggtcagtcccgccaggccggacgacgacagggcggcgacctgcaagacgctgagcgaccgtaattgggtggttgaaagcgcatcgagggtggtggtgttgaggccgttgacctgggtggtggacagccccgccacctggagggtggataggcctgccacctgagtggtggtgaacagccccaactgggtggcgctgaaacccctgagttgggtgacggtcaatcccccgatctgggtggatgacagggcggtcaactgggtggaattcatccccaccagcacggccgaggctaggccgcccaattgggtggtggacagcacgggaagggtggacgaggacagcgcccccaactgtccggcggtcaggctgctcatctgagtggcgctgagacctgccaactgggttgtggacagcgctcccatatccgtggtggtcaatccgcgcatctgggtgatgctgagccgcgacaattgggtggtcgagaattccccgagctgactggtggacaggccgccgatctgcgtcagcgtcaggctgctgatctgggtgacagacaggccgccgacctgtgtagtggacgcggcggccaactgggccgtggtcaatccgacgatggcggcggcgctcagggcgcccaactgggtggtggtgagctgcgccacctcggtggtgctgagccccgtcacctgggtctgggtcaggcgtgccgtctgagtggtggtcagggccgcgaactgggtgctggtgacggaactcagttgagtggtggaaagcagcgccacctgggaaacgctcaatccggcgatctgggtggtggacagggtgttcacctgggtggtggacagggcctgtagcgcgctcatggatagctggttgatctgggtggtgctgagggcggcaagtcccacgctgttcaggccgcccatctgggttggcgtcagggatgccagctgggtgctggcaaggccactgatctgggtggtggacatggaggcgatctgggtggtggacagccccgtcacgttggtggcggtcagcgcgcccaattgcgtcgtcgacatgccggagagctgggtggtggtgatggctcccaggtcggtccgctccagcgccgccacctgggtggtggtcagtgccgccacgtcggtggtctccatggctgccacctgagtcacggtcagtgcgacgatctgcgcggccgatagcgaggccatctgggtcgaggtcagatcggccaccaccgtggtgctcagggcccgcacctgggtgacggtcagtcccccgatctgggtggcggtgagggcgcccagcttggtggtgtccagcgccgatacttgggtggtggacaaccccccgatctgggcgacggtcagttgggacagctgggtggtgcccagggacgtcaattgggtggtggagagtcccgccacgccagtggacgacagtccgaccaactgactggtcgtcagcccggccaggttggtcgtcgaaagtgcgctgacctgagtggtcgagagcgctccgaattgcgtgctggccagcccggcaatctgggtggtggtaaccgtgtttaactgggtggtggacaggccgcggatctgactgacgcccagcgctcccaactgggtcgaggccagaacccccatctgggtcgtgttcagcgctcctacctcggtcacggtcagcccacggatctgcagcggggacaggacggcgatctcggccgccggaaaggcgtccacctgggccgcgctcaacaccgccagctgcgtggcggaaaagctcatctggacggtggccagcgcctggatctgtgtcgtcgacagcgctgccgtctgggcggtgcccaattggctgatctgggtggacgacagcgcctggatgctggtgacggtgaaggcccggacctgggtggcgctcagcgccgtcagcgaggtggacgacagcgactgcaccgccgtgaccgacagggcggagatctgggtggcggtgagaaaggaaatggacgacaccacggcgcagcacttccagttcgggaaagccgtaaccttcaccgaatagcagatgcggttataacgccgggttaacgtggaacgtgaattgaacccccggcggagctttgccatattgtcgccatgcttgccgccgatgttttttttccgccgccgcgacgcgccggtgggcaagcgaccatgaccaacctgcaggacactcccatgaccctttgtttgaaattctctttgccgccggcgcttggactggtgctggcggtcggcctgtccagcccctcctgggccagcgacgcgtcggacgtggcccgcgaaatgaagctgccggttccggtggtggaaagcactctgttggccgtggatgggttcttcgccgcgccggccgctcccgccaaccgtatggtcagcggcaccttcaaggaactggccctcaaggctatccgccatcgcatgggcaacctggaagacagcgttcccggcaagtcgtcggatgcggccgccgaggaccgcaacgccaactacaaggtcaatgtccgcactacccgccacgaaaccacggaaagccgggaatgcgtggacaacaaggtcaccctgaccgccagcgaaggcgtgccggtgatcaaggacggggccttcatcttcgacaccgcccatccccgggtgacgacccacggctgggacatcaccttctgccgcaccccggcggcgtcgggcggcttttccgattgggtactggcgccggcgtcgcgctagactcccccttgtccgtcagcccccggctccatcgggttggaggctggcggcgggtatgcccatacggcggcggcacttggcatcttggccgaatgctcccacaatgcgtggtgtgcgggggaaggggcttgaagaccatgctgaagctgttgacctggattgtgtccattggtgtctggtcgtcgggcgccctggcggccgagatcgttcgcgccgcctacgaggacaagtcgcttcccccctattataccggcacgtccgaggtgatcgatgccgatgcgccgggcgtttccgtcgaactgatgcgcgaggcggccaaggccgccggcctggagatccagttcgtgcgcatgccctgggtccgctgcctgaaatccctgcagcggggcgacgtggacgtgatcttcaattcctcgttcaaggaagaccggcaggagatgggggtgtatcccatggccagcggcaagccggattcctcgaagcggctggcgactatctcctatgcgctttaccgtctcaaggggagcgcggtgtcctatgacggaaaatccatcaccggcctcgacggcggggcggtcggggcgtcgtcgggttattccatcatcgaggacctcacccgtatgggggtgaagaccgaggaggccgccgataccaccgccaatttccggaagcttgccttgaagcgcattccggcggtggcggcccaggaggcccaggccgaccccatgctgatcaactaccccaacatcgagaaggtgatgccgcttctggtgtccaaggattactttgtgatggccagccatcagttctacggccagcggcgcgacgtggccgaccggctgtgggccaagatcgccgaggtgcgcgaggcgcgctcggcggctctccacgccaaatatgcgcgctgagtccggggctcagttcaccggttcggcaagggccggccgttccgctatttgcttgaagacgatcagggtcaggtcgtcgtaaagcggctgggcgccgatatgggccttcacgtcggcgatgatgctgtccttgatggcttcggcgggccgctgccagttggcggagatgacgtcgcacagccggtccaggccgtaaaggcggtgccggtcgtcggccgcctctgtgatgccgtcggtgtaaaggattaccgtgtcgccgggccgcagggccacggtcacttcgttgacgaagcatccgatctcgtcgaccagacccaggggcatgcccagatccatggtgtcgatcagttcgatcgcgccgccctggcgggcgacgatgaccgattcatgctggccgctgatccgcatatggctgctgatgccggggtcggtctcgccgtccggcgggccggggcggtaatccagcagggccagggtcaggttcttgtcgctgcccatgcgctggatgttgttgaagatggtgcggttgagcacgtccagcacccgttcggcgccgtcttcgtcgccggtgatcatggtgcgcaccgcgctttgggtcatcagcatgacgacgccgctttccagcccgtggccggtgacgtcgccgatgccgaagcgcacccggccgttttcgccgtgcaggatgtcgtagtaatcgccgccgacctcgttggccggctccatataggtggccacgtcgagcccgccgatggcggccagttcgccggcggtgggcagcaccatctgctggatgcggcgcgagacgtccagttcggtgcccatccgcacgttctctgccttgaggatgaggttcagcgagcggatttcctcgttggcggcctcgacctcgcgggttcgctcggccacccggcgttccaggtcatgggttagcgccatcagttcggcctgggcggcgtcgcgctcgttcaggccgcgctgcgacgaggtcagaagggcgttcaggctgtcgaccagttcgcccagctcatcatggccgtggccggccagggcgggaaccagatgccgtccgggctggccgggatcgacccgcgtcaccgcctgggccagacgcagcagcgggcgggtgatcatggcgtagaagatgcccaccaccagggcgacgatgcccagggcgcgggccagccccaaggccacattcacacgtccgcgggcgtagaagtcgctggcgacggcctggggggaaagccggacttccagccgccccacatcggtcttgcccaccgcgcccaatcgcaccagatcgcggcgatagaccaggatgtcgccgaacagcagctcggcgagccgcgaggtggcggcggcctgtccctcgcgccggcgctcggccagcaggtcgccgaaattatcctgcagcctggccgcctggatgatctcgtaatccagtagcccttcgaccacccgctccgccagttgtgggctcagctgataggccgcctccaccgccgagccgtcgatggcgccgatgatctgggagacctgggcctggacctggctgcgcttggcgtgccagtcgaagaacagttcgaccatgccgccggcggcgctcagcaccaggacgacggcaaccgttaccaccgcctgcttggcggtcagtccgcgcaggcgtgaggtcatccggctcaaatgatctccatcctcagcgacggcatcagcttgcacagattgaccagggacttgccttgccacgctaccgccttggacccgaccacgcacaggtccaccgtcttgcgattgcggatttcgatgacgaatttcgacagcatggcgatgcccgagctgttgaggaattccagttccctcaggtccagaaccatggctccctcgggaaccgcctcggacagcaaggtggcgatgggggcgtattcctgcaatccgttgaggcgaaggatccccttcaacgccacggtctttgtcgcggcgtcccattcgacggagtgttgatccccttggatgagggtttgcatgtctcgtccctgtctctagatgtccagccggacctgggtggtgatctgggaactgccgtcgggcagggtgtcgaaccgccacgccagcttggcgccgtaatcattgagcatggtcagcagtcccagcccggagccgccgtcttcacccgcccgctcgagctggcggagatacatttccgacgggtccgaggcggccagggcgcggacaaagccgagaaaggcctcgccacgctcgccgctggtccggttgacctcggaaaacaggatggcgtcgggaaccaggagcagttggatggtggtgggcacggcgaggctctcctcgctgtacttcatggcgttttccagcaattcgttggcgatgtaggccaccgcgctgcgaatgtcctgctgccgcgccaggctggcagggtcggcctcgtccttgggaaagaacgtggtgacgtaatcggccagaaaatcggcggatagtccgttgttgcgccaacgctgcttcagcggaatggaactggccgagaaggtcagcgtcaacccgttggtaaccgtgcccatcaactcggaaaaatcgccgatgacctctgccattccctctcccctcggaggttgcaagtgccgttcgcgggccggagtgtgccatccttccccggcggccacaagtcagccgtcgcgcagaaaggccagtccccgggcatgggctgctgggatctgagccgccatggccagggcatcgtccagacgcccttcgcgcaaggcgccctccacggcgcggcaaagaccggagatgccgttcaggcccagttgtcccgagcatccgctaaggctgtgggcggcttctcccagggcttgtccgtcgcgcatggttgctgcccggacaatggcttcggccagggattgcgagacggtccgatagtcgccgatgatctcgaccaggccatcgtcgccgatcctttcggataaggtgacgagggcggcgcggtcgaaatcggcggtcaggcggccccgcatctggcggtcgatggcttcggtcagttgttcgggggtgaacggcttggaaataaagtcgttcatgccggcatccaggcactcccgtgcctcttcgcgggtcgccgccgccgtcagggccaccaccggcagatggccggcggggggcggcatggcccgcagggcgcggaccgcctgcaggccgtccatcaccggcatgtgacgatccatgaggatgatgtcgacggggtgcgacgcgatgacctccaaggcctgggcgccgttttccgccatcagcaccgtgtggccctggcgggagaggaagccgccggccacgcgccggttgaccggattgtcctcgaccaccagcacggtgagactctgtcctgcctgggcggcctcctgccccctgtgggggagatcggccgggcccggcccgatcgcccgtccaggggcgccaaactggtcgagagcccggatcagggccgcttcgcgcaccggctcgggcaggattgccaccgcatcggtttcccccgtggtgggcgtggttcccaggggcgacaggatgatggcggcaagcccggaattccgggccaacacctgcgcctcggaaagcgccatgcgtccgccgagcagcagaacgtcgcccggccgccccagtgtcgcggcactggccttggtggcctccatgacctggatgccccagccggccagaatggttgtcagcgcggtgcggaccggtgcttctggctccagcagcagcagccgcgccggagcatgggccgggcgagaacgtccggggcttgccgccacggggatcagcggaatttggaaccagaacacgctgccctgtcccgcgacgctgtcgacgccgatctcgccgcccatcagttccaccagctgccggcagatggacaggccgaggccggttccgccgaatttgcgcgatacccaggcggcggcctgaacgtagcggcggaacagctggtcccgcgcctcctcgggaatgccgattccggtatcggcgacggcaaagcgcagtccctcgccgccggtcctgtgaacgggcacccgtgtcaccgtcagggtgacgctgcctttttcggtgaatttgatggcgttgccgatcaggttcagcagcacctggcgcaggcgggacggatcaccggtgaccatggccggaacatccggggcgatggcatgggctaccgccaggccgcgctcggtggcacgcatgctcatcaggccgaagctttcctccaccagatcgacgaccttgacctccaagtgctcgatctgcagcttgccggcctcgatcttggacaggtccagcaactcgtcgaggatgttgagcagcaggcggcccgaggacatcacggtaccggcgatgtcgcgctgttcctgggtcaggggggtgtctagcagcaactgggtcatgcccagcagcccgttcatgggggtgcggacctcgtgggagaccacggcgacgaattccgtcttggcctgcgccaggctttccgcctgctccttggcgaggttgatgcgctcgttctcaaggcgaagctgctcgttggccagctcctgctcgatgtcgatctcgtcgctgtgctgggtgatggtgtggaccagcatctcgaggtcggccttctgctcgcccagggcggcaagcaggcgctgcagcttggcctcggcccggatgcgctcggcgatctcggcacgcatctggtcgttggccagcgccagttccgcctcgatggcgtcgccatgctcgatggcggcctgaagctcgatctccaggtccgagcgctcctgttcgcccttgtcgagagccgcgcgaagacgcgcgagttcatctctcacggcaaggtcccgctcgtctgttccggcccggcttgtcacgcgctctcccgttccgcggattcttcgcccaggcggcggcgaagattatcatcggctaatgtcgtatcactgatggcaggaacagacggcttgatcaaggcggatatgtgacacgacagttagggttaggacactgccggaccccggacaatcccggatgaggccggatgtggccggatgaaaccaaggaaattcgccgttcgcggcgcaggcgacgggccaatcgttgtcgttggacggtgtggtgaccgcgacacttaaaccgaccgggcgcgacacatagttctggcccggaaattcggcgcggccaccaccgccctcgatcatccgcagcaggtgcatacgattgacgcgacggcgcgcatcaggtgcaatgtcggctggggcagtccaaacgaccttcacgccaagcgtttaccttcgtcggacgtaggattcggtgacggcgcagctagcaaacggcgccgtaactggccggcggcgaggcgcaaagcgcccatcttctcttcccaactctccaagccagcagcggcgatctcgttgtagatctccgcggtgacccggcccatgtcgcgtgggccaatcttggcgccgcactcggcgtagaccgtggtgacgacttcgttgatccggccgttcaactcggcgtcaagaaccgcgaacgcattgagcaaaaaagccccagagccgcaggttgggtcaatgatcgactctccggtctgcatcgcgccgctccccgtcaggagccaattgatgctgtaaccccttcgggcgatccattcgagcaaatcatttgaaggctgccgcttgcctgtcgcatagctgctgtaggtacgaagtggcacgccagattgagcggcaatttcggcctgggtcagtcccattgaagctcgaacctgctcaagtctctgcccgacagtcatggcgtccaacctgcgtagtccaggttggacgccaacgtccaagctgggagcggccccaattttcctgaaaaaccgttgaaaaacaaaacggtgccaaaaaaggccgaaacgtgcgtgcgcccataggttggacgcgctgctttgcgcttgatgcgccattttgtgcgtgttatatcccttgtcatgtccaccgtacctacaagcaaccaagtcccaaaagaacccgccaggcggcgggtgtggatactgggcgaacttcgcctccggggcacctcgttgcgccgccttgcggcggaacacggggtttcccagcaggctatgagccacgcgctgatcgcctcctcctcgcatttggaggcagtcatcgccgaagccatcggcctgacggcccagcagctgttccctgagcgatttgacgagcaggggaaccgactgagctggacccgtgaacagcagcgtatcacgcgtcaattcgggcgcaatgtcgaagaagggcgcgcagcatgaacaccgcgccaatttccaccgcgacgtgcaactggaaagcctcatacgtggcgctggcggccctgctgacgcgccgtcgtgccgccctgcggatcagccaggaagtcctggccgatcaactgggcgtcggccgttgcacattccagcggtgggagagcggcgagatcgatccgccggccatgcggctgttccagtgggcctccctggtgggcgtgaacattgcgccagatatggcgcaaccggcttcggggagggcggcgtgatcgccgctctcgcccataccctttccctccccggagggaaaacccgccggcctgctggccggctgcggcagggcattgccgcgcctcccaaactcaaggccggacgcgacagcgcgcaaatcgtcgcgtccggcttctttttgggagctgtcaacgacaacctcctggaggcaccaatgaccagagcccaaaagggccggcgccgtgcagccgatccccgtcaattcgatttcatgcagctgctggaggcggcggtcgaactgcccccgacgcaggaaccccgacgcgaagccggggcgctcgacctggatcagcgcctgcgccggttgctcaacgacgccatcaaagccggcccgtactccgaccgcgaggccctggcggaagcgatcagcttccacgccgggcggacggtgaccaaggcgatgatcgattcttggaccggggccgggcgaccgcaccgcctgccggccgacctggtgccggcgatctgcgtgtcgctcggcaattcgatcctgctgcatggcctggcggaagcctcgggctgcgcggtggccgagagcgccgagttgattcgctcccgcctcgaccgcttggccctgttcatccgcttcgccaaggccgaacagcgccgcttgatcgacagcgcccccctgttccaggaggcgcgccatggatgactggcgcagcgcgggggaatgggctgaggccgccaaggcggccggcgtcgatcccgacatgatgcccctgagcggccggcgtctcagcgaccacgcgaaggccagcaactggccttgccgtccccgcaccaagagcggcggtggggtcgagtaccacatcaccgccctgccggtggaggcccgcctgctgatctcgcgccacgagctggccgaggcggtgcaggccggccgcgccgaggggatgcgggcggtcttgcaggagaccatggacgcgcggtcgaagctggcggccaggaccgccgggctggccgagttcatgcgcctgtcgcccgcccaacagcgcgaggccgaggcaaaggccgcggtgatcgacgcctgcgcggcgttcgtgcgccgcctcggcctgccggccaagcgcggcaccgagatcttcgccaccgagtactcggccgggcgcatcccggtcgaggattgggtgcgcgacgaggtgtccaattgctgccgggggtccatcgagaactggcggcgcgagcttgaccgccacggcctgtccggcctggccgccaaatacggtcagcatcgcaagggcgccggcaagatcgacagcaatccggccatgaagcagttcctgctgggcatgctggtcgaccacccgcatgccggcgccggcttggtgatgaagggcctgcgcgcccgcttcgacgccgacgagatccccgacctcaggtccgttcaacgctggttgaagacctggaaggaggagaacgagcaggtctacacggcggtggtcaaccccgattcctggcgctcgaagttccaggccgccggcggcgacgccgacgcccacatcgtgcggatcaaccagcgttgggagctggacagcaccaaggccgacctgatgctggccgacggtcagcgccacgtcatcgtcggcgtgatcgacgtgttcacccgccggatgaagttgctggtcagccgctccagctcggccgccgcggtggcggcggtgctgcggcgggcgctgttggactggggcgtcctggaacaagccggcaccgacaacgggtcggactatgtcagccgccacatcaagcgggtgttcgccggcctgggcgtcgatcacgacgtggcgccgcccttcacccccgaacacaagccgttcatcgagcgcggcctgggcaccttcagccacgacctggtcgagctgtgcgccggctacatcggccacagcgtggccgagcgcaaggacatcgaggcccggcgcagcttcgcccagcggctgatgcgccagggcgagacggtcgagctgcgcatgacgcccgacgagctgcaacagttctgcgacgagtggaccgagaacgtctacggcatcgagccccactccagcctcaagggcaagtcgccgttcgagatggctgcctcgtggaccggcccggtccccaccatcagcgacgagcgggcgctcgacgtgctgctggccgaggcccccggggatggtggcttccgcacaatcaccaagaagggcctgcgcatcgacaacgccctgttcgaggctcccgcgctgggcggcctggaaggcagccgggtcaaggtgctgctggacgaggccgatatcggccggatctacgtcttcgacgaggacggcgattacgtctgcaccgccgaatgccccgagcgcaccggcatcagccgcaaggagctggccagcgcccgcaaggcccaccagaagaaggtggtcgccgaggagaaggcggcgctcaaggctgccgcgaaggccgccggcaccaaggacatcgtccgcgagatccgcatcgagcgggccgaggccgctggcaagctggcccgcctgccccacgccaagaccgtgcacagcacccccgccctgacccaggccggcaaggccgcccggcacggaaaagcccccgcgcccaccccggtgtctgcggcccagcaggcgcgcatcgcccagctggaggccgaactggccgccccggcgtcggcggaggtggtgcagttgaacaccaagaccgcgcagttctcccgtgccgtcgagttggagcgccgtctggcggccggcgaggcggtggcggcggcggatcggcgctggctcgacaacttccgcgccgggccggtctaccggtcgcggatgcggatcatgcaggagcacggattggaggccgcactggcggtctgaacggaaaacggcggccaccctggccggtgaccgccgctgatcaggaaaccctatagcgaggttcaagatgacgattgatgtttcccccgtcaacaccattgcgccgctgcgcaatgtcgccatgctcgacgaactgatcgagcgcatcctcggccgcgccgagaacctgccgggcttcggctgctacttcggcccctcgggctacggcaagagcttcgcggcgatgtacgccgccaaccgccaccgcgcctaccacgtcgaggtgaagtcggtttggaccaggaagcacctgtgcgtctcgatcctcaaggacatgggcatccagccggccaagaccatccccgagatggtcgagcagatcggcgagcagttggccctgtccggccggccgctgatcatcgacgaggccgaccacctggtggacaagggcctgatcaacacggtcaaggacatctacgagtgcagccacggcaccatcgtgctgatcggcgaggagttgctgccgcacaagctgaagtccatcgagcgcgtccatggccgcatgttcgactggatcggcgccgagccgggcaccatcgccgacaccaagcacctggcgcggctctactgccgcggcgtcgcggtcgccgacgatctggtggccaagctgcatgacgattcagccgggtcggtgcgccgcatctgcgtgaacctcgcccgcgtccacgaggccgccatcggcgccgacctgcacgagatggacctggccgcctgggagcgcctgggcggggtgttcttcaccggcaacccgccggcccggaggactttctgatgcacccgggtcgcaagcccgtccacctagtggcggccggcggcaagccgcaggggcgccagggcatctgggaagcgatccgcgccgcccgcgagtccttcacgctgcccggcctggtcgccgccaccgacatccaccgcgacactgtccgcagctacctgcgcggcctggaggcggccggctacatcgtggcgctggaccgccccaacttcgccgacggcgcgaccaaggtctaccaactggtccgtgacgttggcgtcgaggcgccgcgggtgacccgcgacggcaagccggtgacccagggggccgcccaggaacagatgtggcggaccatgaagatgatccgcggcgacttcagctggcgggatctggccatcgccgccgcgaccgccgaaaccccggtggccgaggaggccgccaaggattactgcgccaacttggccaaggccggatacctggcggtggtcaccgtcggaaagggcgtggtcggcgccggaaaggcggggggcgtgcccacccgctaccgcttcaaccgcgcgaagaacaccggccccaagccgcccatggtgcagcgggtgaacagcgtgttcgaccccaacctgcgccgggtggtgtggatcgaggaggtgcgccatgacggttgacgtcaagaccaccgccccggcgaccgcactggggcgcgcccgcttggcctggggcgacgacatgccggcctggatcgaagccctggccagggcctgcgacgaggccagccagaagaaggtggcggcccgcgtcgggtactcgcccgcgaccctctcctacgtcttgaacgcccgttacaccggcgatctcggcgccgttgaacaggcggtgaagggtgcgctgatggccgagaccgtgaactgcccggtggtgggcgagctggcctgcgatgcctgccttgtccaccagagggcgccctgggcgccccacaatccgcagcgcatcgccttctatcgggcctgccgcgccgggtgccccaactcccgcatcggaggtggcaatgctcagtaacaaaatcgaggcgctgcgcgagcgcctggtcatctacaggggcgagggtttggtcctggagccgcagggggtggacaccatctgcgccatgctggccgccttcgcctatgacgcccgccagttggagcagtcggcggtgtccgatctggccaaggccggcgacgacttgcccgagaacgtggtgcagatcgccaccgtgctggcccgcaagggcgtccgggtcggcccgcgccctatcggcgggggagacgcggcatgacggcgctccccttcaccgcggagaccgtgttccgcttccgcgacggccgcgacgagatcgccgccaccgccgtcggcgccctggggctgccggggcggtcgcgggtggtgctgatcgacaccgccgaacgccattgggtggtcgaggtcagcgccgatggccggatgacccaggtggtcgccggcccgatcaccggcggcgaggcgctgcacgccgccgaaaaggtgatcgccggcattcccgaccacggatcggctaccgccctggtgcagatgctcgcggtcggcctggtcgccagcaccctggccttgacccaggcggaagggagggcggcatgagcacgccccgcctcagcatcgccttcgtccagcaccaggtggccaaggcgtttggcatcgatccccggatgatgacctccagccagagggccaagaagctggcccgcccgcgccaggtcgccatgtggatcgtcgcccggatcatgccatcgctgtccatgccgcagatcggccgcgccttcggcaaccgcgaccacaccaccgtcatccacggcgtgcgcaagatcgaggagatgcgcggcaacgaccccgcctttgccgagctggtggacggcctacgcctgtccatcgtccagcaggtgaccgcgcagatcggcgccgaccagctcgccgccgaacgcatggcggtgtgcgtcgccgacgccttcgaggtggccgccctgaccctggcccgcaccgatcccgaggcggcgatgcgggccttcgccccgctcgcgcaggccctgcttggcggttcttccctgcaatccgaagaggccatgccatgcggatgaccgcccgccattccttccgccgcgcccgccgattggtgcgcacggccctccattgggcgaccgcgcctctgcgcgtggccggagccctcgttcttctcgccttcaagacctgctgaaaggaccaacacccatggcgaaagccgcaacccgcatgaaagtcgccgccgccgccttcgcggtcccgcagaccgccgaggaggccaacgacttcgtcgccaagctgggcgccgcccagcgcgagcgcaccctgatcgagaccgccatgaacgacgagctggccgccgtgaaggcgcgccacgaggccgaggccaagccgttcaaggacgagatcgaggccctgactcgtggcctgcacacctacgccgaggccaatcgcgacgccctgacccgggacggcaaggtcaagttccaccgcttcgccgccggcgagatcgcgtggcgcacccggccgcccaaggtgaccgtccgcggcatcgacacggtggtggaggcgctcaagcgcctgggcctgacccgcttcctgcgggtcaaggaagaggtcaacaaggaggccatgctggccgaacccgaggtcgccaccaccgtcgccggcgtcaccatcggcagcggcggcgaggacttcatcgtcaagccgttcgagaccgagctggaggaggtggcaccatgagcacaaccatcttcgcctactgctatgccagcggccagatcgagttcggcccgcgtgtcccccagggggcgctggccatcgccaaggggcgggaggacgcgctccgcgacctgatgtgcggcacctcccgccacgcctatgacggcgaaacgttgctggtgccgggcgtgcccgaggctcccaaccagatggccgcggtggagaagctgatcgcgttctgcgactggctcgcggagcgcaacaccgagggcgtcgagatctgcggcgcccggaagaagcggtccccggccgcccatgtcaccaccggcaccggtgcggccatgccgatctacggggagggctgaggccatgggccgcctgctcgacgccctggtggcactcgacaacgcggcccgcgtgggtgcccgcgtgctcgggaccaccagcggcgtgggccagcaactccagcaggccgccgccatcgtgcggcgcgagctggcgccgcgcgccctggccgaggaggcgacccatcccttcgatccgaagaccgacctcaagcgcattttggccgccgccagcgcggccggcctggagtggcccgacatggtcgaggccctgaacacctttcaccagcaaaaccttggagcctgacatgacccatatcgatacccctgttcccgacaccatcggcacgccctatggcggcggcttctacgccggcgagttcctgctcgacggcaagctttacgccctgatcgtcgcgccgaaggcggagggcgagaccaccgcccagttcaagacgcgcaacaccgtcaccaagggtgcccgctccctgcgggacggcctggccaactccaacgccatggcgaacggcaaccacccggctgccgccttctgccgggatctggagatcggcggcttcaccgactggtatctgcccagccggcacgaggcagcgctcttggcggaaaacctgatgcccggcgagggctacgtgcccgaacagaccaccgccgaggcgttcaagaagggcggcgccgaggcgttcgcccaggactggtactggacgagcaccgagttcggttccggctcggcgtgggtccagctcttcgacaccggctaccagggcagctacggcaaggactggagcgcccgggtccgggccgtccgcaaatgccccctttgaccttcaccacttcttccccggccgcttgggcggccggggccaccgcttgaactttggagattgagatgacccatatcgaccccagcatcaccggcacccttcccgccatcggcgccccgttcggcggtggctatttcgccggcatctacctggaatacggcgccctgatggcgctgatcgtcgctcccaaggacgagggcgaggccgaaagcctggaatgggggccgagcggcaagaccgacgcccgctcgctgatcgacggcctggccaactccgaggccatcaacgacggcgcccatccggccgctcagttctgccggagcttgcggatcggcggattcgacgactggcaccttccggcgctggatcagatgacggtgttgcgcgccaacctgaccccggagaacgaccacgtcccggagcagacctctgccgaggcgttcaaggagggcggttccgaggcgttcgagatcgacgactgctactggacgagcaccgagtggggttccggctcggcgtgggtccagcgcttcggctacggcaaccaggacggccacggcaagggctggagcgcccgggtccgggccgtccgcaaatatcccctttgaccttcaccccttcttccctggccgcttcggcggccagggcggctgacgcctgaggagattttgcatggcgcgcaccactgaactggcgatctaccgcccggcctacgagctgttgcagcttctcgcgaagctgacgcagcagtacccgcgcggctatcgccagggactggggcgcgaggtcttcgcggaaggacaggcggtggtggttcggattttccgggccaactccgccggcccggacagccgcccttcggtgctcgaagacctgcgggaacacctggagacgctcaagctgttgctgcggctctccaaggacctgcacctgatcgcctcggcgtcatatggggccacggtggaactcaccgacgccatcggtcagcaggcgtcgggatggctgaagtactcaaggagccgtgcctgatgctcgaaggtcaaggccttccggcctgcgcacatcatttggtcggggtagcggcggcgtcgatgcaattggtcgtcgctccaggcgccatcgtggatacggcgggtgctcccccgcgcgtcccggcgcagctcggccggcgtcgatgccttcggcaatcgccggcccggcctgtacacccccgacagatccggctcggcgtgggtccagaacttcaacaacggcaaccagaacaacaacaaggactggagcgcccgggtccgggccgtccgcaaatgatcatccagcagccatccgagatcaccgtggcccaacttttcgaggcctattacgagtgccgccggcataaacgcaccacgcgctcggcgctggccttcgaggtcgcgcttgaggccaacctgatgcaattgctgaccgagctgcgcgccggcacctggtggccggcgccggccaccgtgtttgcgatcacgcgcccgaagccccgcgaggtttgggctgcacagttcagggacagaatcgtccaccacctagtctaccgtgccatcaatccgctgttcgagccggccttcatcgccgacagctgtgcctgcatcaaggggcgcggcaccctctacgccgccgaccgcctggagcgccacctacgctcggtcaccgagggctggagcaagccggcctattacctgaaagccgacatcgccaacttcttcggctcgatccgccacgacgtgctgttcgccatgctggcgcgccggatcgccgaccccaccatgctggagctgtgccggcgcctggtgttccaggacgtgcgccagggcgccatcgtccaggacgccgccggcaccctggcccgtgttccttcgcacaagagcctgttccagaccccggccggcatcggcctgcccatcgggaacctcagcagccagttcttcgccaacgtctacctcgaccccgtcgaccagatggtcaagcgccgcctgaagctgcgctacgtccgctatgtcgacgacatggtgatagtccaccaggatcccaaggtgctgctggccgccgccgacgcgatccgcgcccacctgtccggcctcggcctgcacctggccgagagcaagaccttcgtggcgccggtcgaaaagggcgtcgatttcgtcggccacgtcatccgcccgcaccggcgctccgcccggccgaagacccaccgcgtcgccctggcgcggatatccaccatgccgaaggccgaggtgcccgacagcgccacgtcctatctcggcctgttccgccattccggcagccgcgcgcagatcgccgccgtcgcccgtgtcgctgttcggcgcggtttccgggtggaccgcgaactgaccaaggtggtcgtgaaacgaaaggtctccaaaaaatgaccatccagaacaccagttcggccgtcatgtcccagcgccgctcgccgccgcgggcgctcgactactttccgacgccgccctgggcgacccgggcactgctggaacacgtcaatatccgtgccgggtccggcggccaaggcgagggtatggtgccttgggagctgctgacggcctgggagccggcctgcggcgagggacacatggcccgcgtgctggccgaacgcttcggcaaggtggtggccagcgacgtgtttgactacggcatcggcgcgtcggtctacgatttcctcggcgctggcggcctggccgccgccccgccgccggtggagcggccggacttcatcatcaccaacccgccgttctcggtgggccaagccttcgtcgagcgcgccctggagatcgccacccacggcgtcgccatgctggtgcgcaccgcgttcctcgaatcggctgaccgctacgacctattcaagactcatcccccgtcggccgtcgcccagttctcgggccgcgtgcccatggtcatgggccgcctcgatcccgccgccagcagcgccaccgcctattgctggatcgtctggcggcctcccgtgctgaagtgggcgcgggacaaatacggacacacgggcatcatcgccccccacctgttctggattccccccgatgcccgcgcccggctggagcgccccggcgactatccggcccaggccgaaggaggcttgctgtgaccccttcaacggacgttcaacaggcccggaaagcgtggttcgcggcctgccgcgagatcaagctgggcgacgaggagcgcaaggccatccagtcgcggatctgcggcaaggactcggccagcaccatgacggcccgggacttcaccagatgcctttccgacctcaaagaccggggcctgtggaagccatcgcacgcccgcaagcgggccggcaaccgccccatggcggccgatccccagtcggcgaagatgcgggcgctgtggctggcgctctaccacctgggcgccgtccgcgatccggcggaatcggcgctcacggccttcgccaagcggatgaccggcaaggacgccctgcaatggctcgacatgagccaggggaaccgggtgatcgaggcgctcaaggattggtgcgtgcgggaaggattctcaccgtcccgtgacgggacggtgtcgaagcaactgctgctctatgcgctgtgggccaagctccacgccctgggcgccgtgcggatcgccgacacggccgcgctggacaactggctcaccaccggccggatctcgccgcacaccaccgcggtgacgatgctgtccgagcagcagctcgaccaggccgccgaaaagctcggaacgtgggtgcgccgggcagcggccgggaggaagaattgacctcggcgcattcacaccttgggctgataaccgggcggcagcatgggcatgtcgtcctcggtttcgcgcagttcctcttcgctgaactcgtactggcagaagcggcagaccctggccgccgccttgatggtctcggcgcagcgcggacaggtcttgctatgtgcgacttcggctgcttgccgctgctgcgcctggacatccttgagattggacgccagcgccacatggataagcgcgaccggccacaagagcagtccatagatgagccaggcgcctgcacttcgacctttgttgctggcgatcagcgcgacgatcactgcgaagacgatccaaatcagagcgacacccatcaccgacatccccctttgattgccggtccagtttgccacccgcccgcgttgtggtcgagccagacgagaggatgatcatgcacgacgaagatgcggtctcatgggatgacctggtcgccatcatggggcgtgccaatgcagacaacctttcagtcatgcggggcggtcgcaacatttacgtcccccatcaacccgggttgaacagccctttagtggcggcggtcgggatggaggccgccaacgccatggctgcccgccatggcggcaacgtcatcaccgtgcccatcaacgccggcaagcgcgtccgcatccgtgccctgaaggccgaagggcgcagcaatagcgagatcgccgccgtgctccaatgcaccgtgaggttcgtctacaaggttctggcggaagatcccgaacccgaggcgcccagcaaccagcttgcattcgatttgtgaagctgagaggctgtccagcagcagggaacgcctgcggatgaacgagttcatcctgaacgtaactctccccgccagttagcgtcgatccggtcaaccaaccggagagcgcacccgtgcccgacatccagcgccccaccaggggattgaagaaccgcaaccccggcaacctgcgcttcaaccctgccgtcaagtggaagggtctgaccggccaggacaacaagggcttctgcgtcttcaacagcgacgaagccggcatccgcgccgccgtcatcgacctgcacaccgactacgtccgcgatcaccagtgcagtgtgctggcactgatcgccgaatacgccccgccggtggagaacgacaccaagaactacgccaagttcgtagccgaccgcctgggcgtcgatccgctggccaccatcccgttcaccccccacaccgccgaagagctgatccgcgccatcatcaagatggagaacggcatccagccctacccggatgcggtgatcgtcgaaggcgtcgccgccgccttcgcccagttcgcccccaagaccatcggggccaaggcatgaccggaccttcccacctgctcgccgcctccatcccgctgctggtcatgatcggcggcgggctgatggcgttggcggtgcgcgtcgttctcaaccgcttctcccgccggcctggcgccggccccaaccccgaccaggagtgccgcccgtgaaaggctaccgcaccgtgatcttcaacgtgctgatgggcgtggtgtcgctcgtcggcctgcaggtttcccccgacaccgtccagcattgggccggcctggtggtcggcgcgtggatggtgggcggtatcgtcctgcgcttcatcaccaccaccccggccttcaagaccgccatgccggtcgaggtgcagcagctggcgcagctgatcgccgccaatctgcccggcggcaccgccgaacccaccgccgtcgccgacctgacgcccatcccggcgccggccgagggcgccgccaccatcactggcccgccgggcgacctggtggcgctggccaccgagatcagccaggccctgtccaccatccagctggttcacgaccaggccatgggcaacttggcccaggcccaccaggcggtctcgtccgccctgccggcggcgctggcggccatccagtcggacaccaccgcgctcggtggtggcggcaagggcggtggtggcattggcggtggctcccagcccgagcagctgcaggaggcggcccatgcgtaaggtcgccctgatcgccgcctcgctggctgccgcgctgaccctttccgcctgcgacaccgcccgcaacgcggtcgaggcggccaagcccaagacctcggcccaggcggtgtgggaagcccgcgccctgttcgacgccggcccgctcaacgccgccgccgcctatgcccgcctgccggcctgcgccagcgatggccaggccaaggcgccctgcgccaagcccgaggtggtcggccagctgtccaaggccgccacggcggccctggcagcgttcgatgcggccgaggccaccgtgcgggccaatccgcagaccgacgccgatctggcgctggccggcaccgtcaacgcggtgcaggcggtcaagaccatcctcgacacctacggcatcaagtgaggtccgcatgaacgcgctgtccttcatcgagcagctgctcaccctgatcccgctggcggtgtccgtcggcgaaaacgtcgccgacctggtcgaccggggcaaggcggtcatcgccaccgccgacgaccccaccgccgacgactgggccttcctgcaccagttggaggccaagctggccgcgcagatcgacaccgccgccgcggccaccgtctcgggccatggctgatctcgccgacctggccaaggaacgcgaggaagcgaaccgggaggcggctctggccgccttccgggcgcgcgcccggcccacgggcgaaagtgcctatttctgccgttcctgcggcgaacgcatccccgacgagcgccgcgctgcggtcccggggaccaaccattgcacgttctgcgcccagcagatcaccgcggcttcgccgcattccattcgataggcgctggacgcgccgggggaacgatagatgcatttgccggaatggaccgacatcgggttgaaggtcgccgaaatcgtcggcgcgttgctgggaaccatcggcggcgtgctgatctggatggtccgacacaccctggtgagtcaggacgatcttcgcgcccgcttcgaggagcacgacgaggaccacaaggaactggacaagcgcctggtggacggcgagcgccagttcgccgccatcctggccgacctggagcacctgcccgaccacgaggacattgccgatctcaaggaccgtatcggcgcggtggaagggtcggtcaaggccctgggcgccaccatcgacggcctgaaggaggttctggaacgtgtcgagcgtccgttgaacatcctggtcgagcaccacatgaacggaggccgcaagtgaccgccggcgacgatatccgcgccgatctgatcggctcgcgccgcaccttcatcctgcgcctgctggtggaggccgacggctacgtcaacgaaagcatcctggtgaagcacgcgctgaaggccaatcccacggcctcgcgcgaggacattcagtccgacattacgcatctgatttccgtcggctgtgtgtccgaggaatggatcgagacccccgacgggaccaaggccatccgcaacatctccatcacctctcgcggcgaggatgctgcccacggccgtctggcggtccccggtgtgtggcgctcccgctggcagcgggggtaagccatgccgctgcccagcaaggccgaccggctcccaccccccctccgcgaggcgctggcgaacctgtggtttgagcagaagtacagcctcgaccagatcctggcgcacctcaacgccctggcccgtggcgagcggtccatgctgcctcccgaactggccgccgccccggcgatcccgcccgaggcggtccccggccgatccggccttcatgcccatctcaagggcgtttcaaaagcggctgagaaggtccgccgcagccggatggcggccgaggtgctggccagggagttcggcgacgccagcgacgacaaggtggcacaggccaacttcaccatgctccatacggcggtcaatgacatcttcatggctgctgccgaggccgagggcgacgaggacgggccgccggtcaccatcgacccgaagtcggcgatgatgttggccatcacgctggagaagacagagggagccaagaagaagcacgcggatctgcgcgcccagatccgcaaggaagccgccgccgccgctgtggccgcagccgacaaggccctgggcgaggttcccgaccgcgcggcggtgctcaagcgcatccgcgaggaagtgtacgggatcgtcggcgaatgatggcggctgtcccccttcacctgtaccagcgggattggtttctggaccgctcccgcttcaagatcggcatgttcgcccgccagaccggcaagacgttcaccaccaccctggagatcgtcgacgactgcttcgaggcgtgggcgcagggccagcgggcgcgctgggtcatcctgtcgcgcggcgagcgccaggccaaagaggccatggatgccggcatcaagctccacgcccaggcataccagatgggtatcgagagcgaggtcacctacgactggcggcccgaggacaacccggatgtttcctacacccccggcaagctgaccttcgcagccgcgcccgccgccggcgccgccatcgaggccgacttctcctactacttcccgtgctttttcgaggaggacacgctcgacttcgccaagttcatgcacgcctgttaccgcgccgacaaggtcgccttcctgtcggagaaatagccatgcagccccacactccagaactgaaggcgctgctggccacccgccggttcttccgcgccgacctctacgtgatctttctgcccgacggcaccacgctgcgctacagcggcgccgactgcgacatcttcgccgagggcggggtctggccatgcggcggcgccgtcggcccctatttcggccgcaccggcaaccggcccaagatccaccagaagctgggcaccgacgtggacaacatggtggtcgacgtgctgcccggccgcgccaccatcctgggcgttcccttcctgaccgccgtccagcagggcctgttcgatggcgcctggctggaataccgcaaggcgtacatgccgacggtggccgatgcccgctattggccgctgcgcaccaccggcaccgtgcgccgattcctcggccgcatcgccgaggccgacgccggcggatcggtggccaccttcaccgtcaacagccccatggagctgctgcagaagccgctgccccgcaacctgtaccagcccggctgccagaacgtgctgggcgacctggcctgcggcaaggatctggcggcgctcaccgttgccggaatcgtcctgccgggctcgaccgccatgatgctgcaggccgatctggccggcgccgacggctggttcgacttgggcacggtcaccatggccaccggcgagatgctcggccagtcgcgcacggtgcgccgctgggaggacggcactctcagcctggtgacgccatttccgtcgatcccggccaccggcgacgccatagccgtgatcccgggctgcgacggctcgctggggcctgccggctgccccaagttcgccaacctcgccaactaccggggccacccgttcgtgcccccgcccagcacggccaactgacatggaccacgcaaccgaacgcgaccaggtgcagcgcgaggccaagacctggctgcgcacgccctatcatccccgccagcaggtcaagggcgccggcgtcgactgcgccatgctgccagcggcggtctatcacagcgccggcctgatcccgaaaatcgcggtggagtactacccccaggactggcatctgcaccaggacgaggagcgctacctcaagattgtcgagaccttcgccacccgcatggaggggccgcccaacccgggtgactttgccatctggaaggtcggccgctgctgggcgcatggcgccatcgtcatgggctggccgcgcatcatccacgcggtgatgggccagggcgtggtgtggggcgacgcccaggtggactgcctgggcaaggatcaccgcctggccgacctgccgctgcgcttctacacgctgtggggcgagggctgatggctggcatcttctcctctcccaagtcgcgcacgccccaggcccagcagcccacggccgccgccggcgtccagatccagacctcggcctacggcaaggcggtcgccctggtgttcggcaccaccaaggtggcgccgaatctggtctggtacggtgacttccagtccatcgcccattcctcgggcggtggcggtggtggcggtggcggcggcaagggcggcggcggcggcgacagcggcggcggcagcaccacctacacctacaaggccgccttcgccttcggcctgtgcgaggggccgatcaagggcgtggggcgcgcctgggcggccaagaccgagaccacgccggcggcgctgaacctctcggtgttcaccggcgcctatccccagctgccctggacctatctggagagccaccacggcgaggcggtcgagcgtcatacggttccgacccatgcgccctacaccgtcacggtcaactacccggcgccgccgttcaccgattccggcgtggttgacgagatcgacgggcgcaccttcaccgccaccgccgtcgccccgggtgtggggcagtactcggtggccaacggcacctacaccttctcggccgccgacgccggcatcgagctgcgcttcacctacacctcgggcaaccagcagccggccaaccaggcgctgggctataacggcctggcctacgtcgccagccccgactacgacctgggcgacagcccgaacctgcccaaccacaatttcgaggtccagggcatctactcggattcggtggacggcgccgaggacgccgacgcctccctggtggtgcgcggcctgctcaccgaccgccattggggcctgggcaatctgatgccggccgacctggtgggcgaccaggcgctctaccgcgactacgtgctggcctcgggcctgctgatctcgcccgcctacagcgagcagcagacggcggcccagatgatcgaggacatcggcacctacaccaacgccgacgtggcctggaccggcaccttcaacatgctgccgcgctgccatgaggtggtgaccggaaacggcgtcacctacaccccgcccgaaacggtgttcgacctgggcgacgacgactggatggacagcagcgacgccatcaccgcctcgggcaccaacatgaccgacccggtggtgctggtgcgcgcccgcccggccgacgccatcaaccaggtcaccctggagtatctgaaccgcgccaaccagtattcgcccgagccggtcaccgcccgcgacgtggccgccatccgcgcctatggcctcaaccaggacaagacccgccaagcccatctgttcaccaccggcacggtggcgcggttgtcggcccagctgctgctgcagcgccaggccgcccgcaataagtggcagggcaccgtgggcgaggagcatgtgctgctcgatgtcggcgacaccggcttcatctccaatgcccgcctgcgcctcaatcgccagctggtccgcatcgaggagatcaccgacaacgacgacggctcgcgcgccatggtgttcgaggagatcctctcgggcgccggcgtcgccgccgcccacaccttcgccgaggccctgggcagcgcccctagctacaacgtcgatccgggcgattgcgtcacccccatcttcttcgacgctcccaccgagctgaccggcggtctggaggtatggatggctaccgccggcggcgaccagtgggccggcgcccaggtgtggatctccagcaacgacgagtcctacgcccgcgccggcacggtcaccggcgacgcccgcatgggcgcgctcagcgccccgctggacgccggcgccgaccccgacaacgaccacaccctgtcggtggacctggccaagagtggtggccagctgggctctggcacccgtgaggacgccgacgcgctcaatacgctgtgctgggtcgatggcgagttggtcgcctatcagaccgccacgctgaccggcgttgaccgctacgacctgacctatctgcggcgtggcgccttcggaaccaccgtggccgaccatgccgccgacagccgcttcgtccgcgtcgaccgctcgctgttccgctacagctacaccaaggaccagatcggcaagccggtccacgtcaagctgctgtcctacaacctgttcggcggcggcgtgcagaccatctcgcaggtttccgcccacacctacgtcatccaggggccgccgctgccgccggcggtcaccggcttcggcgcccagcagcagggcaatgtggtgaccttccattggtcgccgctgaacaactatgccgtggacatcgcctacggccccaaaggctgcaccgatggcgtcaccgtcgaccaggcgtgggcggccatgagcatgctgaccgaatcggcgcgcggcaccgagatgaccaacgccagcgtgccgccgggcaactggaccttcgccatccgcgcccgcaacaccttctcggaccagctgtcgcccacgctggccaccgtcgacctggtcgtcaccaatgcccagatcgtgctggacggcaccggcgccaatttggggccggattggctgggcggcgacctccagggcctggtgcgccactggaccggcaagctggtgccccagtcgcgtggtgtggcggtggacgacggcgataccacctgggagttctgcccgaacccggtggccgcgccggtctggaccggccccgccatcgacaccggcaccatcgacgacatccgcatctgggcgaccgtgtccaccagcctcggccccggcaaccaaggcaacgtctccaccaccttcgccatggactggagcaccaccggggccgactggaacggcacctatcagccgtggacggtgggcagcgtccatgcccgctacatccgcccccagctgcgcctcgacacctcgctcggcggctgcctggtcaccggcttcgtgccggtggccgacgtgccgctgaagagtgaaaccatcaccgccaccgttcccgccggcggcgggtgggtggcgttctccaagccctaccacgccccaccggccgtcaatcccggcgccgccggcgcggggctgaccagcgcatccgccgtcgatgtcaccgcctacggctgcaccgtgcatgcctggagcggcgccaacgacgtgggcggccccgtcgttctcaccatcggaccaagcccatgaccgccaccttcgttcagcccgacagcaccgcccaggactcgaccacctacaaggccaacatcgacgcggccacggcggtggtggcggtcctcggccgcaatttcgccccccaccaggccgagccggccaacatgaccgtggtgctcgacgccggctcgatccagggcaacacctcggtggtggcccatgctgcccaggtcaccccggccttcattgccccggtggccaacccgcgcctcgacctggtcgtcgtcgatgcgtccaccggcgtggtgtcggtggttgccggcgccgaggcggcggcaacccagctgccgacggtgccctcgggcaagatcgccgtcgcccaggtccacctggccgtgggcatggccgccatcggcaacagcgacatcaccgacctgcgcaccccgtttcgggtgcagcaggccgtcctgggcgtggccggctggtactacgacgacgccaccgacgccctgcacttcacgatggattcggcggggtcgatcaccctgccgggcaatcgcgaggagtggaccttcctgcccaccaatgcgtcctgcgccctggacgccaacggcaacctgatcctgaccatctgagaggggaacccatcccatggatatcaatcttggccgcctcggcttcgtcgacagaggcaactacagcgccgccacggcctacgccgtccgcgacgtggtgaccttcaacggcaacacctaccggtgcatcgtcgccaccaccgcagggcaaagcccaacctccacgccggcaagctggctgctgatggcctcggggccgagcggcgtgatgaccaccaacggcgacctgctctactacaacaacggccttcaacgtctggcggccggcagcaatggccaggcgctggtgatgaccggcggcctccccgcctggggtaccggatcgcccattattcaggtggtgaagatgcgcgacactacccggcgcaccggcctcggcagcgacaataccgtggtctgctcgggcgtcgccctgttcaacaagcagcaggcggcatccaaggtgtggttgagcgggatcgtgatgggacaggggccggccggtaacaacgttacggtcccggtgttgacgttgaccgacagcgccaatgcgaccttcgacatcatcgggcgctacggattcgaggggagcggtggctacgcccagccgatccatttcaacgaccccggcattactggtttggcggcgggagccgttacctgggcgctgaggcagacctcctacagcaatgcttccaacgtggcgatcagcatcatgaacccggacaacaatgacgacgctcgttggtatccgcatgggaacgccagggaaagccacaccaccttcaccgtcatcgagcacaactgaggccagccatgaccgccaagaccgacatcatcttcgtgatcgcccacgaatacgccacccaggtcgcctcgggcgatgtgcgggccgtgctcgaaggcgaccccgacaactacgacggcctgcaatggatcagtgagacggtcgagaagccgaccatggccgtgctgaccgacctgtggaccaccaagtaccagggcctcgctgccttggcgcaggtccaagccgcgcgccgtcccgaatacccgtctctggccgacttcgccgatgcctattactgggcggagaagggcgaccccaccaagatggccgcctatgtagctaagatcgacgcggtgaaggccaagtaccccaagccggccgcctgaccgatgatggccctggtcaacaattccagggatgttttccccgccggtattggccggcggggggctgggcgttgcagcgcccgaagccgcgagtttacgcctcgcatgaccagacccggccggttttccggtcatccccgcacccgtgcaccgggcggggcgagtatgggcatgcagatccatggagtccattcgctgtggcacctgccagcgcaagctggccgaggccgacatcaaggaggggaagctctccatccgctgcccgcgctgcggcgccggcaataccatcgagagggccaagagccccgaacccgagccccctggagggccgctggacgaaggctcatgaccatcaacctcgatcaccgttccgtcacccccgtcgatcccgccgtcggctacatcggcggtaagcgcaacctggccggggccatcgtgcccctgatccaatcgatcccgcacacctgctacgccgagccgttcgccggcatgggcggcatcttcttccgccgcaccagggtgccgcgctcggaggtgatcaacgacgccagccgcgacgtggcggtgttcttccgcatcttgcagcggcacttcccccagatgatggacgtgctgaagttccagatcaccagccgggccgagttcgagcgcctgtgccgggtcgatcccgacaccctcaccgacctggagcggagcgcccgcttcctgtacctccaggccacggcctacggcggcaaggtcgccacccggaccttcggcgtcgatcctcgccgcggagggcgattcaacgtgacgttgctggcccagcgcctcgccgaactgcacgagcggctggctggcgtcgtgctggagtgcctcgatttcgaggcgttcatccgccgctacgaccgccccttcaccctgttctacgtcgatccgccctacgccggatcggagggctattacggcaagcacctgttcaagcccgatgacttggtgcggttggcgaccgctttgaagggcgttcaagggtggttcatcacctcgaatgccgactgccccgaggtgcgagaagcgttcgccggctgcgagatcagggaggtccggaccacctatacggccggcggccgtgggcgggtcaaggcgggccgcgaggtcatcatcatcgggggaggaaatgggacgggatgaacccgttcaccgtgggccaaacctaagtgtcgtccgggccaaaacttcgcggcgcgctacaggatatgaaggccatccatttcgcggcattctcccaaagaaaaaggccctagccgggtaagcggctaaggccttgatctaactggtgggccgagcacaccaaaacaatcgcgatatataattgtattgtattgatattttttagtgccgtatggtggggtacccccaaatgtacccccgcattcgattggtaggggggcaatttgccacggggcggcccgtgatggcgaaaggggggaggcatacggtatgggtgccgtcccgtggccgtcaatgggcggaaagggcgcggcgggtgcccattgtgccgccggaaccgaagggccgccacgggccgccgttcggacctaagttcgtgggccgaggctccggcatgaggtaggggggggctggccagtaggatctctttttctgcgttggctggacccgcagagatatccgccttcgggaccatgacccacaatgacccatcttcgccccagtcccgccgctatcgccccgctggccccttgagaaactccaccgggtccacttccagcacatccgccagccgaccgatgattttcaggctggcgtggtacttgccggtttcaagctgggctagatagctccggctcatttccgcgtcgcaggcaagttcgtcctgcgacaggcccttatcgtggcgcagtcggcggaggttggtggcgaatagctcccgcagatccatgcgggtagccaatcaccttgctggaaagttgcacctcgatatactgagcaaactgcccggcagcccgatggggcggtggaaagtcagtgcaaaactttttccggcaaaaacagcacagcgctcgtcatatggttaaacgggccgaacatgctatcgttttgagcgatggatggggccgaacgggggagcgggcggatggcattcacacggaaaacggttgggttggcggttggcattcttgccctgagcggaattgccttcgcagcccccgagtccaaacccgccccatccgtggaactggcccgtagcctgatcgccgccgaacaattcgagcaggcagttggctatatcggaaaagctgaatgagcaaaattcagaatactcacgtcagttcatgggtaagtttcttggcaggtgctttcttgctaggcactggggaaatagcaaccgccacagcaggacaactcgaggacggggtggaagcctacaaacttggaaaatacactgaaagtatttatattttaaggccactggcagagagtggagataaagacgctcaataccatattgcgctaatatattcaaatggatatggaattccacaagattacgaaaagtcatcatattggtataggaaagcggccgaccaaggacttgttaacgctcagatcgttgttgggtttggatattatttaggacgatggggtttttctaaagattacgtcctttcccatatgtggttaagtcttgccgccagccaaggaaatatagatggtgcaaatgagcgtgatcgtctcgcaaggcgcatgtctccagccgagattgctaaggcacaaaagttggcgagggattggaaatccgagggtaagggcttggaaaaggttgtcgtcccttcaccaccaaaatcagccaaccctccgcccaagtcacctaccttagaacccacccaaagcggcgtcctgactgacccgctaatgtcactccagtacttgaaagcccctcatagaccggatgacgtggcggtgattatcggaaattcggactattccctcacgtcaaatgatatcccatcagtgcccccggcaaagaatgatgccgccgccatgcgccgatatgccgctgaggcgctgggcatccaggaggggaatatcatctttgttgagaacgccacctcgacccagatgacagagattttcggcaacgagcgcagccacaagggcaagattttcaactgggtgaagccgggaaagtcgcgggtcttcgtgtattacgctggtcatggagcgccgatcagcaaagatacggccgtgctggtgccggttgatgccacgccatcggggctgccggtaagcggataccctttgaacttgctctacgccaatcttgcgaagctccatgccgagagcgtgaccgtggtgttggagtcgtgcttttcgggggccagtgaggcgggggcggtgatcgcagccgcttcacccgtcctgataaccgccaagccgtcaatagtgccgccgaacatcaccgtcatagcggcgggggcggcggatcagatcgcctcctgggaccaggacaaatcccacggccttatgaccaaggcgttcctgcttggcatgtccggagatgcggacaagccgccttatgggaatggggacggagttgtctcttttgatgaaatagggccttacatatcggagaacgtaaaatacatggctcgtcgatactgggggcgagatcaggatgttattgttatattaggtcaaattagagacggccaatgattagctcgagcgacatggtttttgttgatttcgtgttccgggaaaaagcgcgcgagcttattgatgagctttatcgaaaagaagaagctctgggaattcgcaatagaattgaattttttagcggagggcgcccatttcctcataccagccaagagagcctagctcaatatgctaagagcgaagacagttattttcgtggaatgataaggaattgttattttaaagacatacaaaatgcgagcgatagggctgatttgatatctattcgtatgaaattgcgcgaaacttacatgacttgctggagtgaaactctcgaaaatataagaaaatctgcgcattttgaggaatttgcatctgagttcatgcctggatcagtaggagtgattttgtttcttattgcaataatttttatgcatgtgtccggatataggcttttcaatctccagttaattttgggggcggggttagttggtggggctagctatgtcttgctctcgctttggcgggggatgcttctaaaagaagcgattgccaaccttaataaggccctctctgcgacaccaaatgcacctgagaaagacttgttttctaatagagaggcaatgacgggtgaacgagatatagaatttgaaagttatctttttgtaaatgggcttatttaaatgttgtccatcggacaatggctttggggacattgtgtttctgtagactgggaaatgtagatgctgaaggaatagcgccataacaacccgatggggtggcgaatggcatggcacccatctgggagctctgtgtgtgggggggctcggagggtagcatggtatttctggttgaggcggtatcggcaatctccgtcgccccgcaattagccgcacgtatccaagggggatggaaagaggcgtttaccctcccgctggatcagatgcacaaggcacggcttcggcctggacggaagaaaggtcagctatcttgactcacaattcgttgccacctgtagaacggctcccccctagctattcgcccaggcaagttattttggactgctacaagctcgacttccccataaatggggggtggggctacgcgatggaagatgcatgtgtaattgacaaaggggatcataccgtcgaaaaaaacatcccatttgacggcgttggtgttgagtatgcttttgtagaaaagaggatttactgcgagctaattttattcctacctcgtgggagggaatattctggaatttcgtggaaattgcttcagcaggatttgataaatcgcgatggtcgggatttcgacaggttaatgtattcagtgaccgcgctgcccacttcggattgggagagccttaaggctgaatgggaaggacctgacggcattcgctccccaaccttcgacagcgaggctcatcataggaagcacgagtcaaaaaccatttcgctggttcgggagtattggttcgatatcaccagcttttatggacagaccggatagctgaataccgggtttatgggggccgtgcgagagggtgttttgagtctgggcgccgataaggctcccaagtcaggtgcccgtcccacctttgattatcgaacatggccccagcccttctccgggaaatcgactaggaaccggggcggcggattgcgaaggaatgcgaagaaatatccagcaatccagggcggtgcgggccgcgagcccggatcgtcgggagttcggccagggtcaggtcgcgactcgggggcggcaccggggtgctggccttcgggatgctgttgcgattaaccagccatacctcgtccggccggatcaggatgctgatcgagtcgtatggggttgatccggtggcgcggcgctcgcggtcacggagttcgtaaaggcggcggcggaggcgacgggcctcgcggggatcggcgacggaaaggacaatgccgacatcggcggcaagggcgcggtcgaaggcgtcgcgaaggtggtcggtcatggcgtcaccgtatcggcatttggatggggggtgggggaggtgttatcggtcatcttcaaatcctttcgttgccgtgaccccgtggcgggacggacgggacatcggacacccccctaaaggggggatgtcccgtatgtcacgatcccccgcccaagccgggacaaggacaatcggtacaaatttccctattgtcccgtttgtcccgatatgccaacgatccaaacccaagtgtcttccaccttgaccttcattgtttccagtagtttgtcttttgctcgccgaaaggctgtcctcttggcttccgctttgttgtcgtggatttccggcgcagcgtagaaggcattccgccagtcattcatcagcactccgcgcttcccttttccatccccatccggaaccggctgcccacgctcatcgatcaccgctttcaacacccgtaacgcaacgacagcctgcccggtttccttctttgcaatttggaccgatggactgggaatagccggttcaatgacacaactcgtcaccggtttgccccgaaggttattgccgagtctaacgacatggagagcaaaagattgatcctcccctaccgccatgtctcgctgcttcttctgcttcaggacggcaatctccctcggattgtccgggcattgaatggctaggattgcatcaaaatccgttttttctgttgaattggcgctgtcattagaagttttttctgtatcttttacctcattttcttttttcacccctttggaaatctcaatctctgtgtcgatagacccaagcaacgagctgtgtccacgtgcgccattattgagatttttgccagaatggtggatcagcatcaggtgagcgcctgtttcacgtcgcaccagatcaacatttttgatcaattcccccatagcttgagagctgttttcatcgcttccatccaatgctcggtttaccgtatcaatgatgacaagcttaacttgaccagcctccttagagatcagcattatcacatcaattaatttttgaactaagccgtcaagaagtgtgacccgcccttgtactgtgtagtacggaacttcacattcgattgacttatgctttttccatgctgccacacggtttttcaccgcattgccaccttccagcgcgaaatgcacgacaggtccgccagtgacttcttttccccaccaagagcgattagccgccacgtgtaagcctatgtccatcgcaatgaaggtttttcctgcattgctcgggccaaacatcacggaagaaccgccctcgcaaagcaagccctccacaaaatccagtgtgtcgaggattggctcaacttcacaaaatcttgtgacagccagccctaatgcagcgaagtcaacttttcccatcggaacagtccaattttgatgtgcaaataccgctagcaaatttcagcagaatggagactatgggccgacctgggtcagccctggccccctgaggcgatagatgcggctgatcgctgcgttgatctccagtgccgcatcttctagcccgtgggctttgtggtgctcagtcaggtccatgagctgacgcaggaccgtttcccatgcctcgtcgcttgacgccacggcctgttcgagaatgtggcgcacctggagctgggcgacttgaatttcagagttcatgttgtcggaagtcattgctcagggtcctcgccagaaagcaggtctttgaggctgctatagacgacgaggcggcgggaaccgatcttgattgtcttgattttctcagccgcgataagttcatagaacttggtgcggcctaagccgcttgccctcaacgcggctgggaccgttagagtgatcgggtcgagatcattcattgttgtcctccataatccgtatgaacggggatggatggacgattacatgtgtatggggtgggcgcgacggacagaaaaagaaagaaaattattgtccgcgaatgcggcggtataagggcttgtttttagagcaattttctaaaactagccgaccttcacttcgctccctaagaagtcttctgagtctcttctcaattgcagactcgctatgaaactccttcggcctttcctcgttagtgaacctagccatcatacgtcggccgagaaaggctgggagttcttctggtgcagagtcgtcttttgccaagctgtcataaagagctaacaggatattctcccatttggacaaattctctttcggtggccgtcctcgtcctttcttgtgaactttgattaattctttccaagttctttcagcgccatcgactccgagtagctgaaccgactcggtgcagaccgcacgcatacgttcaatgagatcaggtgggattgcctccaaactatcgggatcgtcagttggcatgccgccccctcgcctggggaagctgaattacctcagctccagccttgagcgtgtccaggtagtccgaccagcgctgcatcatcgcacgtcgctgttcgatgtacttggtgcggttgtatgctcggccaagggcgtccggcacgcggtgggcaagctgctgctcaataacgtgtgggtcttccccaagctgctcggccaagatcgtgcgggccatcgctcggaagccgtggcccgtaatctcggtcttggtgtcgtagccaagacggcgcaatgcggcgtttacagcggcctcactcatcggctttcgcggatcgcggccgggaaacaagcattcacggttgccggtgtactggtgcaagtcgcgcagaatttcaacggcctgggttgataacgggaccagatgttcaatcgtttcgccctttcgggccttggaggcatggaaggcccagcttccagcatcaaggtcgatgtctgcccacttggcctttctaagttcaccagggcggacgaaaaccagaggggcaagttgtagcgctgccttgacgacgacggtgccctcaaaggcgtcgaatgcgcggagcaactcaccaaccagcttcgggtcggtaagggcggcgaagtgtttgtggcggacaggcggtaaggccccgcgcaagtcgccggtggggtcgcgttcggcgcgcccagtggcgacagcgtaacgcataatttggcctgcgttctgaactgccctatgggccgtatcgttagcccccctggcttcaatctttcgggcaacggcgaggatcatcggcgctgtaatcgaaccgattggcttggtgccgattagcggaaagacatcgctttcaagccgctggagaaccttggatgaatgcgtctcggcccatgtggccacattcttagcgaaccattcgcgggctacgttttcgaaactgtcggggccatcaagcaactgcgatgactttttcgccttccgcgcatcggacgggtcgatgccgttggctagctgtttcttggcgtcatctcgaagctggcgagcggtcttgatcgtcacgtcggggtaaacgcccaacgcgagcagtttttcctttccgccaaaacgatatttcagacgccaatagcgttgatcttgcggggtgaccagcaagaacatgccaccgccatccgccagctttattggcttatcggcgggtttcgccgccttaatttgcaagtccgtaaggggcatttgggggtatctccatcgcggatggacatatctacccccaaatatacccccatgtacccccggcttccagcgatttgatacgaacgcggacggccggattttggtggcccatcctattgtgcgtccgcatgaaatgtcaggaaactcgcaccttccacgaacgtacgcggacatccgcgatcctgtgtggatcgcggtgccggtttcggattttagagaatttggtggagccgagcgggatcgaaccgctgacctcctcattgcgaacgaggcgctctcccaactgagctacggccccgaaaagggaagcgcgataatgttcaaaccgcccggcgctgtcaagcggctaccaccgcatctggccgcccaggggcttggatttctgcatgccgcgcttggtcaccagaacccagtcgttgaactgcatgtagcgcggcgccaggaattggtagatgtccctgattttgtttgtattttcgtccgagcggacgatgaataccgttttccagatctggatgaagtcttcccagggcagcaggcggcaatgcagggcgtcgcgcacctggcggatatagccgatctgattgtcgatatttttcagcatggccaggatttcgccggtctgggcgtccacctggtcgaaataatcctggaagaccttcagcgcccgctgcgagaggcggccgacctggtcggtggtctcgatcatggagcggtcggcgccatagatccggcgcaggccctgcagcttctcgtcgatcttctggacttcgccgaaggtgtcgcgcagcgcctcgatataggccagttccttggccagggattcgatgtagcgcaccacctcgtcgcgattgttgcggcccaggcccaattcctccgccgcctcggtgaaggccagctggacgttcttcttgacctggggatcgtcggcgacctgggccagctcggacacgttgctgatgacgtgctcgttgccggtcagccaggtgaccaactgcatggtcaggcgctgataggcgatgcgacggtggcggtcctggggctcccacgaggcctcgcgggtggtgacctccttgggcagcttgtcgccgggacgcaggccgcgcacgaattgcagcccctcggccaccttgtccagcatcttgaaatcgtgctggtcttccttcatcccgaattcgcgcttgatgccgtcgaaggcgagcaccgcctcgttggtggcgagcttgagcaccgccacgggctcgccggtgtcggtcagacggaaatagagatcctcgaaggacgtgaagaacttgtgctcgaaggagacctctccctcgacctctccggaatccttgcctttgtcgtcagcagccatctctgtcgctcacccctggcggcgcacccccacggtcacgctgccgccccgaaaagccaaaaccacggcaaacacagtatgccgggctcggcgcccttgaacaagaggtggtcaatcccccgcttcgacgaagaggtggccggggcggccatggatgtagccgttggcgaattcggcgcccggacacagggtggccagccggtcctcggcttcaccggcatcggtggtgccggccagcacggcgcggaacagcgcggccaccgccaccatgtcgaaggtctgcggccacaggcggaagcggccgatgccgcgcgccgccagcccggccacatcgcccagcaggtccatggtgtggtaggacatggtctgggtgccgttgactgccaggaagggcacgtcgtccagggtctccaccgccatgccgtcgggatcgtcggcacagacgtactggcagccgtccttggacaggttgcgggcccgggcggcgtagcagcgcgccgagatggccaggggcaggcggccgaaggcctgtacctcgatgtccatgggcgtcgaggtggccagggcggttaccgcctcggcggccagctcggccggcaggcaggcgcgcgccgcgcccatggcggccagggcggccagggtgccctcgttgtagatgttgagcagcggcccggcgacgaaggggcggccgttcatctgcgccgccaccgagatgtcgttggcctccaccaggatgccgtcgctctgggctaggtcgcgggcctgggcgatctcgcggtcggacatgatcagggccagggaggacagcaccacttccttgccggcggcggtcaggcgctcgaccacttcggggatgaagggttcgaagaacggcgtgcgcttggagcacaccacctcgcccacatggacgctgtccacatcggcctcgtcggccatgcggaaatagaagtcgcgaaggacctccggcttccagttgaacagaaccgggccgagggtgagtttgggggtggtggtcattggttcggtcccttggccttgtctgtcatcccgagcgaagtcgagggatctccgcttggcaggatacgggccgatttgaaccgtccggccagaaggagattcctcctcccgatggtcgtcggaatgacggacatgctcatcgccaagccttctcgtaggcgccggtggtctgcttgccgccttcggtgatgcggtcgagatcgatatcgggcagcggcttgccggccatgaccgcgtccaccccggcgcggaaggcctggaccacggcggccacataggcgcggccgcgctggcggccctcgatcttgaaggcggtcacgccggccttgatcagatcgggcagcatggtcagcgtgttgagcgaggtgggttcctcgaacagatagctggccttgtcatgggcgatgaagcggcccttgcacagggtgggatagcccgccgcctcgtcatgggcgaacttgttgatggtgaagccgcccagttccgaggtgatgccctgggaggtctcggtatagcgcacctcaccggccggcgagcacacgccattcatgttgggcgactgaccggtcacgtatgacgacagggcacagcgtccctcggccatgacgcacaatccgccgaacacgaagacctcggtctcgaccggggcgatgcggggattgagcgcggcgatttcctgcaccgtcagcacgcggggcagcaccacccgcctgactccgaagcgctcggcatagaaccggatggcgtcggggttggaggcggcagcctgcaccgacagatgcagccgcagctcgggatgggtgcggtgggcgtgctcgatcaggccgatatcggccaggatggcggcgtcggccttgagcttcgccgcgtcggcgaccgcctgatgccagatttccggctggccggcgcgcgggaaggtgttgatggccaccagcaccttggcaccgcgctcgtgggcataggcgatgccttcgcccaattccttgcggttgaagttgaggccggggaagttgcgggcgttggtctcgtcgcgaaagcccacatagacgcaatcggcgccggcatccacggcgctgcgcagcgccgccggggtgccggccgggcagaccagttcgggacgggtggaggaggtggaggtggagggggagggggaagggagcgatgccatcaggccacgcctccgcgccgtgccgccttgcgaagctgcttcagctcgccttccaactgggctatgcgcgccccctggttggcggaatccttgaccgccggggcgatgatggcggcgcgcagcgtctcgaaatcctcgcgcatgcggcccatcaggccgatcgcggcgccggccagcccgcggaagggccgggccagcggccccagttgcgtgctgatgtcctcgatcaggtcgatgccggcgccatcgatggcattgcgcagcgccaccaccacttcggtgtcgccctcgatcaccagccggcgcgagaagaacagggcgtcgccgtccaccttgccctcggccagggcgatcagcatctccagcgggccatggatggtggcggccacctcgcccggctcgatggagcggcgcacggtgaggcgcgggtccagcgggttgggctccagcaggatgacgaagggcaggtccaccggatcgatgcacaccgccttgtcggcgtaatcggccatgcgttccaggatgtcgggatggcggcggcgcaccacgctcagcatggcgtcgaacaggggctgcagcgcggcgggacgaaacggcttcaaggccatgcccagcagcagcaccggcgagaacggtggcgttaccggatttgtcccggtcctggcatgtgcttgcgtcatgatgtgcggccctctttccctcgagaaaggcattctgccgagcggtcatagccccgcacgttgaccgccgtcaagcaaaggactccggggacgaacgagtcgggggcaagctgcagtagggcttggcagatgcccgcgcgctggctaacctcgcaagagctgtacgagagggggcgtcccaatgaatatcgatgtcgatctgagcccgatcaccgcgctcatcatcgacgattcgcgctatgcccgctcgttcatcaagacggcgctgcaatccttcggcatcaggaccatcctggaagccgccgacgggccgagcggcctggaaatcctggggcagcagccggtccatctggtcatcgtcgaccatgacatggctcccatggacggcatcgacttcacccgcttcctgcgggccggcgagatcgtggcctgcgacgacgtcgccgtcatcatgatgagcgccgaatccgccgctgaagtggtgtttcaggcgcgcagcgccggcgtcaacgagttcctggtcaagcccatgtcggcggattccctgttccgccgcatccgcaacgttctggtcaatcccaaggccttcgtacgcacccccggtttcaaggggccggaccgccggctgctgtcgcgtccgccgcccggtgtggccgaacgccgtgtggcggcacctttggcgaagccgctgcctctggtcatgcccatcggcgccactgccgccgcccgccccgccgccgccccgcatgcgccggtggtccaggcgcccaagccggcgcaggagcggaccggacgcaagaaattccatgccggccagatcgtcttcagcgaaggcgatgccggcgacatggcctatgtggtggaaagcggcaaggtctccattttcaagaccgttaacggccagaaggtcatcctcggccagatcggccccaacggcgtgttcggcgagatggcactgatcgacaacgagccgcgcatggcctcggccatggccgccgaggagacctcctgtctggtgattcccatggctgcgctgaaatcccagatcggcaagactcccgatctggtgatcctggtgctggaaaccctgctttacgacatccgcaagatggggcgcgaattgggacaggtgcgtgccaccctggaaaagaagcgggccggaaagtaggcccctgtcatcctgagcgatgcgaatgatcttccagcctgaagcggcagccgtttgtggctgaaaggcccttcggctgcgcctcagggtgacagaaggagtgctcactcgtccgcggcgaagcggtcgggggacagcggctggggctggatggggtcgtcgctggcgggatagagggaaatctcggcgatattggtcagcgagcggatggtgcccgccgactggtacttgaaggtcagcgtcaccggcaggaccgaggcctgcatctcgtcgaggaagatgccgcagccgcgggaatagcgcgacccggtggcgaattcgatgcggtaggttccctcgggaataccgccgatgccgatgtgataggtggcgggcacgtagaaggtggtgaccgtgttgccggccatggtctttagcttgaccacgccgtcgcggcgcccctcgttgtggaccagcaggcgatggtcaccactgacccggcgcgtcaggatttccccggcgccgggctgggcgccccggttctcgttgcaccactgggccttgaagcgcccgcccgatccggcatagagcgagcgggtctcgacgaagccgtcgatgcccgacggcgtgcgcaccttgacccattcgggatcgccgggggcatcgctcacctcgacggtggtgaagcggtccagcaatgtcagcaccggcgcgccggccagcggcgccatgcgcaccttcaggctgtccaccgccacatggcggatttcgccgctgcgggccggctgcatggcgatgggggcggcggcggtggccaccggctggtcccagggcttggcggcgatcagggcaaagacgccgacggtcaccggcagggccagcagcggcagggcctgggccaggaacacgccgccgccgaggcgccagcgggtcttgagccggcggttgtcggagacctcgcgggtggcgtgcagcagatcctccacccgggcgcggtcatcgggcatgctggcgaagcggttggcctgcagcgccagcgagcgggccagttccaactcgccccgtcccaggaaggcgcggccctggcggatcagcacccgggcattctcgtggcgcggcttggcgccgcccagcaggttgcgcagcaggaccaggggggcgagcagcaggccgggcagggaccaccagcccagcgcccaggtgatggtcgaggcgcgcacggcggcacggtcggcgcaggcccggcaaaaaattccctccaccgtgccggtttttgcccacaccagatacgagcgaacccagtggtagaccacgtagcgcggctgggcggtcagggcgccgcagtcgcagcaggcgatgggggctccggccacctgggcgtcgtcatcatgggtggattcctggccgaacgtgtcgtattcggcgcggcgcaccacgtccttgaggacgccataggcctcgataaccctttgaaattcctcttgcgcgcgcttggaggtattgcggtcgggatggaccttcttcacgcgggagcggtaggcgcttttgatggcgcccgcatccgcccccggagcgaggccgaggatcgcgtaatagcctttggggtcacgcgcgatggtgttcatgccgattggtgcttgtgcctgggccagtggtttgccgggttcttcaagcaaagcctatgccatcggtcgggggagtggaaaagccgcgcagggatcataccacgatttgcgttgccggtgcgccggccggcggcaggtcgacgaaagaccgccccgcctggaaggaaacctgccccttgatgccggtcatctggccgcattcggcgaagatgccggcgatgtcgcggcacatggcggcgggcagcggctcggcggtgcgcacgatcaggtcgaagcgcttggtgtccttctgcaccagcccgtccagctgaatgcggcccagcacgctcatgcgcacctccaggatgaagcgctgttcgctgcccttcttgccgccgccctcgtcctcgttgggcgggcggtggacgtagaggtcgatggggtccacattggcgccatgggcgaagggcagggtgatggcctgccagtcgccccgccccatgggccgggtggcctcctcggccagatcgaggaactccttcttcagcttgtcggccagatcccggcgcccggccttttccaggccccgggtcaccggctcgctgagcaactggcgggcatcgcccgagcgcacggcgccggcgaacagggacatggccgccgccagacggggacccgcctgggggatcatccgcatcagctgctcggcggcctgacggtccgattgcagcagggcgtccaccgcctgatccagggtgggccagccgccggggctcagcccctggggcgggccggcggctggcgccagcggtggcggcggcagggggcggccgatcacctccaggcgcagcacgctgccgatgggcatgggcatgcccacgtccagtgacagggttccggccgggctttggatcacggcggcgccgccggccggctgggccaccacgatggcgggcagggtcacggtctgggacggaggagcggccggggcgggcggcatgacgggagggccggcgggaagggccggggccgtccccggcatggtgggctgggcgatggcaggagaggcatggcctgcgggcggcgcgaccgccggcccggtggcgatggcgggccgggccgagaccggctccgtctggggctgcggagcggcggccggttgcgccgtggcggtgggaatgggctggccgccacttaccgcgccctggccgggcggagccatggcggcgatgcgcaccgtgagaagggtgccggcggcaaggttggtcagcgccgtgggcaggggctgggccatgtccagacccggcgtggcagcattggggggcagcatcaccgcgccgggcgggccggagcggatgacggtggcggtcaggcccaccggccccgccgccagtccgggcgaggccgtcacgggcgctccggccgggccgggctgggccaggggcgatggggcggctggattctgggcctgtcccgccttggcgccactattgcccagcagggcggcgaggtcgggcggattgggcggcaggaggggctggggggccaggcccatggggcggccgttgatggacagcagcttgaaggcgggcaggccgttctgcgagatgaattgcagggccagttgggcgccgtcgggcggcaggggttggcccggcggcagccgcagcgacaggctgctcccgtcggcggtcatcacctggaccacccccttgccctcggacattgtcagggtggcggccagcaccgcaccggcctgcagcttggccagggcctcggcggcacccttgtcggccaccacgctcagcactaccggcgcgctgacctggggaggcagggcgaccggaggcggagccggcgggatggccgagcacatggcggtgctagcgcgagcggatcaggcgctcgacgatggcctcgacatcggcggcggcctcggcgttgggcgagcgcatcatgatgggcgtctggttgcggatggcttcccggaccttgagatcgcggcggatgacgccggccaggggcggcgaaatcttcaggaagccttcgcaggccttgagcagggtgttgtagatgcgctcgccctcgcgggtggaattggccatgttgaccacgatgcgcatgtcggtgccggggcgctccatatgggtgaccttgatgaaggcataggcatcggtcagcgaggtgggctcgtcggtggtcaccaccatgatggtgcccgcctgctgcgagaagttacgggtggtcttctccacgccggcccccaggtcgaccaccacgcggtcgtaattgccggccagcagcaccagatcgtcgcccagcatctgcaggcgcgacagcgggatgttggccagcgtgccggaccccgagcggccggcgatgatgtcgaaaccgccctcggggaagcgggtcagggcctggttgagcgtcatgcgcccggccaccacgctgcccagatcggtcttgggcatcaggcccagctggatgtccacattggccagccccaggtcgccgtcgaacagcagaacccgctggttggcccgcgccaaagcgtgggacagggtgatcgagaaccaggtcttgccgaccccgcccttgccggacgccaccgcgacgatgttgcgtcccttggcccgaagggtggggcggggcgccagggtgggaacttccatcgtggtcatgatgcggatgcctcggtccagaaggtttcatctttgggttcggcctcggccgattgcggcatgatcagccgcgccagcgccacggccgaaatgggcgagatgcccgaggccacatggggactggcggaaacgtcgcagaacgccatctgcccgccctcggcggcggccaggatggagcccaggcgccgcgtggtgtcgagccgcgacgcgaacagccgcgtggcgccgatggcggcgaaggcctcgccgatctcggcggcctcttccgggtcgccgccggcggccatcaccaggacgggctccacgtcggcggcctcgatcagggcctggagatagtccatgtcgctctgcttgaacgggttgaggccgggcgaatcgatcaccaccagatcgaaggcgccgttcacgctttccaccacccgggccagggattccggtcccctggcgcgaaccaggtcgatctccaggatggaggtgaaggcggccagttgctcgacggcgccggcgcggatgttgtcgcaggtgatgacgcccacctgccgctgcttcagcaccgagcgcgccgccagcttggcggcggcgatggacttgcccgagccgttgggtcccaccagcatgaaggggcgcggcgccccgtgctcgggcaggtgggcgaaggtgaagccggcttccagggcggcggcgcaggccagcggcggctgggaaagaccggaggtatgggcggcattgaccagccgctccaccagcttggacggcacgccgtggtcgaccagggccttgcgcaccgcctcggacacctcggacccgccggtggcttcctccagcatggaggccacggccagatcggcatcgacggattccagggcggcggtgatgcgcacccccttggacccggcggcgcgctgggtcgagacgatgatggcgtcgtcgcccagttcctggcggaccagttccatggcctcggccatggtgggggcggtgaaggatttaagcctcatcgaccgctctccctgttatcccgagcggagcgagggatctccgtctggaacgatggcgggagaacggacaaatcggagcaggacgagatccctcctcccggtggtcgtcgggatgacatctgcacgctcatcagatctgccccagtgtcttgatgcgggccttgggatgaatttccgactggctcatcaccacggtcatgggccggaaacgctcgacgatggagcgcacatagggccggaccatggggctggtcagcaggatgggggtctcgccctgcatggcgaagcgttcgaaggtctggcgcgtgcggctgatgaagtcctgcagctgcgacggcgccatggagatctgcttctcctcgccggtgcccaccagggattcggcgaaggcctgctcccattccggcgacagggtgatcagcgggatgaagccctgcggcccggtgttgttgtccgagatctgccgcgccagacgggcgcgcacatgctcggtaatcatggtgacgttgcgggtatggccgcaggcctcggcgatgccttccaggatggtgggcagatcgcggatggagatgcgctcgcccaaaaggttctgcagcacccgctgcaacccgccgatggtcatctggctggggatcagctcggcgatcagcttctggtgttccttgtccagctcgtccagcagcttctgggtctcggcatgggagagcagctcgctcatgttgtccttgatcacctcggtcaggtgggtggtgatcacggtgggcgggtcgaccacggtatagccgcggaacagcgcctcctcccggttggtgggatcgatccacatggcgggcaggccgaaggtgggctcgcgcgtcttctcgcccggcagggtgatgtcctcgcccctggggtccatgatcagcagggcggcggggcgcaggtcgcctcgaccggcctcgacctccttcacatggatgacataggtgttggcgggcagctgcatgttgtcctggatgcgcacgctgggcatgacgaagcccatctcggtggcgatggcgcggcgcagggacttgatctggtcggtcaggcgctggcccttgggggtgttgatcagctgcagcaggccatagcccagttccaggcgcacatggtcgatcttgagggccgaggagatgggttcttccggcaccggcgcctgctgcatggcctcggccacttccgcctgctgctgctgctcggccttggcgcgctggtcgcggtccagcagataggccgaggcgcccatgcccagccccagcaggaagaagggcaggaatggcatgttgggcaccagcgccatcagggtcatcagcgcaccggccatgcccacggcgcggggatagcccgccagctggctgaacagggcgcggtcgacggcttcctgcacgccggccttggtgaccagcatgccggccgacaccgagacgatcagggcgggaacctgggtgaccagaccgtcgccgacggtcagcttggtgtagaactcggcggcctggctgaaggtcagcccctgctgcgccatgccgatgatcatgccgccgatgacgttgatggcggtgatcatcaggccggcgaccgcatcgccgcgcacgaacttggacgcgccgtccatggcgccgaagaaggcggattcaccttccagctcggcgcggcgcttccgggccgtgggctcgtcgcacaggcccgccgacagatcggcatcgatggccatctgcttgccgggcatggcgtccagggtgaagcgcgccgccacttcggcgatacgggtcgagcccttggtgatgaccacgaaattgacgatcaccaggatggcgaagacgatgatgccgatgacgaagctgccgctcatgatgaagctggcaaaggcggcgatcacctgtccggcgccctcgacgccctcgtggccgtgggacaggatcaggcgggtggacgccagattgagtgccaggcggatcagggtggtgagcagcagcaccgtggggaacgaactgaactgcagcggcttttcgatgaagatggccaccatcaggatcagcacggcgatggtcagcgacaaggccaggccgatgtccagcagccacggcggcagcggcaggatcagcatcatcacgatgacgatgatgccgaacgccaggccgacgtcgccgcgccgcgcggacgcggcaaagcgatcgaggatttcccggccgacgctggacgctgatgcctgtccttcagccatgatgctagatcatggctcgttcgatttcgccgccggcgggcggcggcacgtcgatgccttcgtcggaatactgcttcagcttgttgcgaagggtgcggatggaaatccctaagatgttggccgcatgggtgcggttgcccaggcaatgggacaaggtgtcgatgatcaggtcgcgctcgacctcggccaccgtcttgccgaccatgccgcccctcgccccgatgaccgaggcagcggcattggccgcctgggcgaccatgggatcgggattggtgcccaccgggttgcccgacaggatcatggcctcggggccgatctcggcgccgctggccagcagcacggcgcggtgcatggtgttttccagctcgcgcacattgccgcgccagtggtggcgcgacagcaattgccgcgcttcggcggaaagctggcgggtgggcaggccgttggcctcggtgtagcgcttgacgaagtgttcggccagcaccgcgatgtccagcggccgctcgcgcagcgcgggcagcgccagggtcaccacgttgaggcggtaatagaggtcctcgcggaaggtgcccttgcggacctcgtcctccatggtgcggttggaggtggcgagaatgcgcacgtccaccttgaccggctggttgccgcccacccggtcgatttccttttcctggatggcgcgcagcagcttggattgcaggcgcacgtccatctcggagatttcgtccagcagcaaggtgccgccctgggcctcctcgaacttgccgatgcgccgggccacggcgccggtgaaggcgcccttttcatggccaaacagctcggattccagcaggttctcggggatggcggcgcagttgacagccacgaagcgcttgtccgagcgcttggacttgttgtggatgaaccgggcgatcagctccttgccggtgcccgattcgccggtgatcatgatggaggcgtcggaattggccacctgctcggccagcttcaaggtctggcccatgcgggggtccttgaagatgatgttgtggttttcctgggtgacggcggcgatgacggcggcgatcagctcggcgtcgggcggcagcgggatgtattccttggcgccggccttgatggcgcgcacggcggccgaggcgtcggacgcgatgccgcaggccaccaccggaacgatgatgcgttcggcttccagcgaatcgatcagccccttgatgtcgcgcttgacgtcgatcatcaccagatcggcgccctgggcgcgcagcacctccaggccggcgggcacgtcctcggcctgacggaccttggcgccccgcgccatggcgatctggctggcggcgccgatctggccgtcgagcgtgccgatgatcagaagtcgcatgtcatccctctcccgccgtcaggacccttaggcccggtcggtcttgatgatttcggtcatggtcacgcccaggcgatcctcgaccaccaccacttcgccacgcgccaccaggcggttgttgacgtagatgtcgatggcctcgcccactttgcggtccagttccacgaccgcgccgcgtcccagcttcagcaactggttgacctgcatggtggccttgcccagcacggccgatacctgcaccggaatatcgtagacggcttcgagatcgcgggccgaccgaggcatgtccgggacgtcgccccgtccctgctcctccacctcgggcttgaaatcgttgagttcgaagtcgggcatggaatcctcctgttactcttccgggcggccttcgggcagcgccagggcccggttcaccgccgtctcgatatcggcgatcagacgaacctgatcgcgttccgctccgccgtccgtccattccacccggcaatcgccgatggcgacccggggatcggcctggaccaccacgcggccttcgaagccgtgttcgatggcggtgtgttccaggcgctcgcgcaaggggtcgaccagcgacgaatccactcggacgatgatacgcggttcgtccagcacatgagttagacattcctgaaccgtgcggacgacttcctcgaaggcgttctgctcgcaggcagcgggcaggacttttttcaagaccgccatggccacccgggcggcgatcctctggttgaggtcgttggcgtcggcctgggcggcgtccagcatggccagggcgttggacacccggtccagcgaggcggccagcagggcctgctgggtttcgttggcctcggcggtgccgttgcggtggccctcctcgtaggccgcctcgcgcaccacctggaggtcttcctcggtgaaggtgggcggcggcggcagatcgggctcgggctcgacctcgaagacgtcctcggcctgctcggccggcttcggccggttggcgggcggtggaccgaagtccaggtcgaacatgtacttctgataggccatggactagtacaccagctcgtcttcctcgcggccctcggagatgacgatctgtcccgacgccgccagttccttggccatgaccacgatggcggcctgggcctgatccacgtccctgaggcggaccgggccgagcgcctccatgtcctcgcgcagcatcttgccggcgcgttcggacatgttcttgaagaacagttccttgaccccgtcggcgccgcccttgagcgcgatggccagcttgtccttctccaccgagcgcagcagcacctggatgccggcggcgtcgatgcgggtgaggtcgtcgaaggtgaacatcagcgccttgatcttctcggcgctttctcggttgcgttcctccagggccgacatgaaccggttttcggtattgcgatccaggttgttgaagatgtcggccatcagttcgtgggcgtcgcggcgctgggtgcgggccaggttggtcatgaactcggtcctcagagtcttttccacgccgtccagcacttccttctgcaccgcctccatgcgcagcatgcgcatgatgacttccatggcgaagttctcgggcaggatggccagcacgcgggacgcatggtcgggcttgatcttggccagcaccaccgccacggtctgggggtattcgttcttcaggtagttggccagcacctgctcggagacgttgcccagcttgtcccacatggtacggccggcgggaccgcggatttcctccatgatgaggttcacgcggtccttggacaggctcttcatcagcaggcgttcggtggtgtcgaacgagccggtcagcgagcccgtcgacgacagggcgtcggcgaattcgacgaagacgcgctccaccagattggacgagacggtgccaaggctggccatgatctgggacagttccttgatctcgtcgtcgcccagcatgccgaacagcttggacgagtgctcttcgttgagcgacagcatgaacatggccgccttctgggggccggtgaggctgcggtagtcttccttgacgcgtgccatggcggttccctatcagctttcctggtagagccagttgcggatgatggacagagcctcttccggatgcttctcgacgatttcgccgatcttgcggatcgaggaggccttgacgcggccttccaccttgtcgatgtcgatcagttcgtcggcgatgacctcttcctcgccgcccagcggggccggcatggcggcggcgccggggccggtgagctgcggcatggcgccgccatcggtggtcagcaggcggcggccgtcggggccgacctgaccctgcatggactcgatggcccggctgatgagcggacgcagcaccagcagcaggaacaggatggccaccaccgagaggcccagattcgaggcgatcttctcgacgaagtcgcggcgcatgccgaagatgaactcgcccggctcctcggcctgaagcagctcctcgcccttgtagaagggcatggaggccaccttgacctgatcatcgcggtccttggtgtagccgatggccgacttgaccagggcttcgatctgggacagctcttcggcggtgcgctcgcggtacgaggtctgcttgccgtcggccgactgctcgcgcacgccgtcgacgatgacggcggcggaaaccttgcggatctcgcccatctcgcggaccgtgctcttggtcttgcgcgagatctcgtagttcacggtttcctggttcttgttgatcttggtcgaggtgcggatgttgcccgaggacgaggcgttgggatcgggcaggttctgctgaacggtgaccggggtgggctcggcgtcctggctctgctcgccctcgttgacggtgacctgggagcggaccaccttggtctcggggtcgaaggtttcctcggtggtggtggcctggctcatgtccatgtccaccgtgacctcggcgcgcacccggcccggacccagcgaacgctccagcaggtcctcgatggtcttgaccagcttggcctcggtcttgaccttcatctcctcggcggtctgggcctgatactccttggagttctcgaagcccttggccagcagggtgcccttgtcgtcgacgatggagatgcgcgacggcttcatcttggggacggcggcggcgatcaggtgctggatggcgctgacctggcccttgtccagccgctgggcgccgttcatcttgatgatgaccgaggcggacggctcctgggtatcgcgggagaaggcctcgcgcttgggcagcaccagatggacgcgggccgccttgacccggtcgatggagcggatggtcttggacagctcgccttccagggcgcggaccatggtgatgttctgctggaagctggtggagcccagcgcgtcctgcttgtcgaacaattcatagccggccatgcggccgccggcgggcagggcctgctcggccatgcgcacgcgcaggtccagcttgcggtctttgggcacccagacctcggtgccgtccttcctgagttcgtagggaatcttgtcggcggtcagcttctcgatgatctgcttggaatcgcccagatcgagatcgccatacagcaattccatctgcggcgcggcgacgcggctcatcagatagatgaagaagccgagaatactgacgccgacaccggcgatggcggccagccgcatgggccccaggccgcgcagcatctgcaggaatgcgttcacgtcgtctccatcgggtgcccatcgcccaggcgcgcggggggtgccgccggccggcacacacatccaggtgacagactaaggtcttgccgctgaagagatggttaacgcccggcaatttttgccgggtggggttttgctgtattgcgtgagcccctcaggcgccgggcgcgggcgtctcgcccgcattccggacagaatcggaccggcggccttctggccgccggtccttgtcaggaagcaggatggggggattggacgcgttaacgcttgatctgcaccagttcgtccagcatctggtcggcagtggtgatgatcttggccgcggccgaataggcgcgctgggtgatgatcatggtggtgaactcggagccgatatccacggtcgaagcttccagcgacgccgactgcaccgaaccggcaccggcattgttggcctgacgcagggtgtacgagcccgaggtgttggtctcgatccaggaattgccggtcagggattccaagccgttggggttggtgaaggtggccaccgggatctggaagaccggacggcggacgccgttgtcgaacagggcggtgaccacgccgtcggtgcccaccgagacgcccgagaagttgccgaacttggcgccgttctgggtcaaataggccagctgataggtaccgcccagctgggtcatgccgtcggcctgcgaggtgttgcccacgaaccagttgatgcgctggtcggcgccggtgccgttgggaaccagggtcatggactgggcgccgttggcccagttgacggccatcttgcccacgttgacggtcttgggcgtgccgtcgccgttgaaggtgatggcgggattaacctgggtgatggcgttcaggtagaactcgccgttgaccgtgtccaccgaggggatgcccgagctccagttgcgggtctgcgactgggtcacggtggtgcccatgttggccatgctgaacttggctgtggagccgccttgctgctgcacgatctccagcgtcgagccgttggcgcggaacaggggcagcttgccgcccagggccaccacggtcttggtggcggcgatgccgccattggtgttctcgtcccagttcttgggattgcgcaacgcctgggccaccagggtggcgacgtcggaccccgaggtcaggttggtattgttgaggttgatgacgacttccttgccgacggtcggtgagatggtgccggtggtgtcgaaatagacgttgaggtcatagccgccgatggtgatggtgaaggacttggtgtccaaggcctgcacatcggcggacgacgaggcggtgaagtccacccggccctggctggcatagaccagcgacggagtcgagttgtccacgatatccatggaggcggcgcccgagggtgggttcacgccccgctggtcctggtagggggcggtcgaggtggtgacgtagtcggcgggcgtcaggtacagcgccgtggcagtcttgctggagacctggtagtagccggtattgttggtggtgctgaggctgttgctgaccttgatgtagtcgccgaccgcatagtcggtctggctgtaggccgcgtcgccggtgaagtcgatggcgttgcccaggccgccgagattggcggcgaaggcggcggcggtataggtcttgttggcgccgccgatctcgatggcggccgcggtggcgaccgtatcgacgatggtcggcgaggtcgccacggtcgagctgacgtaccagtcgccgttattggtgctggcggtgcccgaggcgccggaaatgttcaggatggaaccggtgggcagggcccgctgcgcggtgaggagcgggttgcccagggtgaattgcggcatggcgatgacgccggttccggcgaaatagcccatgttggtggcgctggcggaggtgaccagggtggtgatgccgttgccggtattgccggcggcggcgccgtatatcttgagggcggcggtggagttctgcttgacgtcggtcagcgtcgaagccaccgagtagaagttgctcttggtttccacgtcccactggttcgagttggtcttggtccagttgacgttgaaattgtgggtgtcgccgagcgagtcgtagatcagcacgctggtctggtgatagccggacgaggaggtgctggccgggttgtagatggtgtcgcccgacggcaggttggcgcccatcttgatctgagtggtctggtcggcggtgccgccgatggtcttcagattgagggacttggtttcctgcggattgatgatgttctggttgacgtagtggaacgtgccgtcggcctgcttgtaggccttcatgtaggtgttgccgtcgacggtcagctcggtcggcttggccagaacgttgttgttggtgggctgcagcggccagccctggacgtagaagcccgacacgttctgcagatagccttccttatccaccttgaacgacccggcgcgggtgtaggcgaacatgccgttgccggacgtggcgggatcaggatcggtgttgaccacgaacatgccctggcccgacagggcgaggtcggtggaattggtggtggcctgcagcaggccctggctgtcgatggccgcccggggcttggactggacgccgcccggcgaataggtggtcagggagacctgcttggtcaccagggtctggaagttgaccttggcccccttgtagccggtggtgttcacgttggtgatgttgtccgaaatggctcccatcgcgctggactgagaggccagaccggagacacccgagaacaatgcgccgtacaagctcatgatatcctcctgatcctaaattctactggccggtcgagctggagccgctcgacgagctagagttgttcgaagagccctgcagcgcctgaagttgcgccagcgcggcctgatactgggcgttggcggcggccaactgcgcgttgttgatgctggactggttgtccttgacgctgaccaccttatccatggtcagggtgatgtcgttgcccttggtcccggcgcccatcaccagggtggtgccgttggtggcgtcgttggtcaccttggtcacccggccgaagctggtgctggtggtggtgatggaggtgccgtcggcggcggtggccaccacctggaaggaatagcggccgtcatcgagctgggtgcccgacgagtccttgccgttccagctgaggctatgggcgcccgaggcggtctcgccggcgatggaattgacctgcttgccggtggaatccttgatcacgattttcacgtcgcgggcttccttgggcagggtgtaggtcagcgaggcggcgctgtcttgcagcggcaggtcggtgcccgacacctcgacggtctggccgagatagctgatgccctgggaggtctgggcggtctgctgcagcttgatcagcttttccaggttggaattggcgttgatctgctgctcgacgctggagaactggaccagctggttggtgaactgggtcgagtccatgggcgacagcgggtcctgatgcttcagctgagtggtcagcatggtcaggaaggtattgaagttgctgcccagcgtggccttgccggcggcggagcccgtggcggccgaggccgttgcggcgttggtggcggaggtgtcgacggtggtcatgggcgttgctcctacaccgagatgtcgacgccggagcgtccgccgagggtccggctccgcgcggcctgggccgcgccggcgccggccagctgggcctcgtcgccgccggcggcggcacggttgcggccacggcgggaccgggtgttgttgttgccgcgatcggcgttctgctgctgctcgccgcccttcaggctgaaggtggtggcggcgctgtcgggcttgagcccggcatcctccagggccttctccaggcccttggcgtccttttgcagcatggccagggtctcgggcttgtcggcggtgacggtggccgagacatggccatcggcgctgacttccagcttgatctcgatcttacccagctcatagggcttcagctggatcttgatggtgtcggcgccgtccttgacctgcttgtcgatctggacggtgacctgctccatcacctgggcctgcagcagggtgcggggggtgcgggcggcggattgggccgcctggccgccggacgccttgtcggcggcctgggccgagcccacgccggccaggccgacgacggtgcgctgctcgggggcggcctcgtcggcagccgaggcttcgacctgggcggccagaatggcggcgaaggggctggcctcggcctcgcccgtcgcggcggcattggtgtccagggtgacggtggcgggggtctgttccacggcggcgccactgtcctggctcgaggcgaagccctgaccctgcgcctgctcctggccgctgccctggccgttgacggcctgggcggcgaggtcctgcagcgacagcgtgtcgaccatggtggctgccgtctgggcggcgggggtggtgtcgacggtggtagtctggactttgatgtccaggtggacgttggagcccgccagcatggcggccagatcgcgggcctgctcgtcggccaggctgtcggtctggtcggtgatgctggcctcggcggcggccttgtgctggccgaccttggtgatcatctgattgaccagttcggtggcggcgtcgagcgcgtcgtccagattgccgtcctggacgtcgttgaccaggcggttttccaggtcggtgatgcgctggcggtcggcggcggacaggccggccatgggatcggcctcaggcttgccgtcgtcggcgctggccagctgggcgctgatggtctgggccatggcattgaggtccagggccggaccgttgtcggctttggtgtcggccacctggacgatctggacggtctcggtgatggtgacgtcgagcgaaacgatgatctgctcgtcgtccttggccttggtctccaccggagcctggacggtgtcgtcgtcggcggtcggggcgttctgggctgaagcgtcgctgtcggcggcctggacggtggccggcgcgtcgtcgtccttctggaccggagccggggcggcctgggcgtcgtcgcccttgcgggcggtggcggcgccggcggcgcggggcttgtcggccttgagcagcggacgggcgtccttggcgtcgggctgggcgtcctggcgggcgtccttggcgtcgaccttgacgtccatgtgcaggcgggtgatgtgctcggacaggaccttgtcgccggagatcaggccgcccaggctgccgtttttgccggcgaagcgctgggtggtctgctgcagcaccgagaggaaggcgtcctcggccgacacgctctcctgctgcttgtccagcgagaggggagtcatgttggcttcgggtaccacacgcttgtcgatggattgcacggtcatggtcttgtccccgcagaatgggcttcgcgaacgatctttcgcgccaagacctgagcaagcggcgggccaagtggtgtcggttcggctatctaattgatatttaatgggaaagatttttacgccctgggtgccgttcccctgtgggacggcggcgtacggaaaaatctgccgggtgcggggaaaagcctgccggttcagtagatgtcgcggtcggcctcgtcgtcccgggccaggctcatgatgcccactcccatggccaccgagccgaaggtgacgaacagcccgccgaacagcaggagcagcaccgggacgggattgggggattccatggccagggtgcggatatggccgagatcggtggccagcaccagggcgccgaaggtcgcgccggccgccaggccgtagcacaggtgctgggccaggaatttcagcggctcgcgctctttgggggtcatggcctcacccctcgctgacggcggcacccagttcggccgccagggcgcgggtctcggccatgacctgctccagccgggcggcatcggtgccgcgggccacgatggcgaccagcgagcggccctcggtgaacgaggggtacgagcccacgtccacctcggggtggcggtcctggatgcgggtcaggccttcggccagatcgccctcgcggacacccagggtcaccgagcgggacaattgcggcggtccttccgccagggtgtggcggatgccctcgaacatggcgcgcaggatggagggaacgcccgccatgacgaagacgttgtccaggcggaagccgggggcctggctgatggggttgtcgaccagttgggctccggccgggatttccgccatcttgaggcgggcggcattgagctcgccctcgccatagcggctttgcaaccggcggacggcttccgggttgcgctccagggcgacgccgaacgtcctggccaccgccgccgaggtgatgtcgtcatgggtggggccgatgccgccgctggtgaagacataggtgtaggcggcccgaagggcgtttagggcggcgacgatggccgccggatcgtcgcggacgatgcgcacctcggccaaggtgatgccgcgcgccgccagttccttgcccagataggcgacattggaatcctgggtgcgtcccgacaggatttcattgccgatcaccaggatcgccgcattggccatgaccgcactcccatatcagggaatgatattatacccactcccgcaggatggcgaccagggggatgtcggcggggggcatgggcaggtcgcccaggcggggcacgcggatccagcgcagttcctggccttcgcgggcgctgggattgcccttccatacccgcaccagatacagcggcatcagcagatggaaggtgtcgtaatcgtgggaggcgaaggcgacgggggctaggcagctttcccgcacgtcgatgcccagttcctcctccaactcgcggaccagggcggcctccggggtctcgccgtcgtgaatcttgccgccggggaactcccacaggccttccatgctcttgccggtggggcgcgacgccatcagcacgcggccgtcgccgtccaccagggcggcggccaccaccagcacggtggggcggagcgagcgggccatcagccactcggccctgcgcagctggaagacgggagagatgacgctttcgccccgcgccggcatggggcaggcgtcgacccggtggaaggtgagtcccaccttctccagcacccgcttggaaccggtgttgtcggggtggaactgcgcccagacccgttcgaagcccagggtgtcgaacagatggcggatcaggcggttggccgcctcggtggcatagccctggccccagaaatccttgccgatccagtagcccagttccggcgtgccgtcccgttccaggccaaagcccatgacgccgaccagcacgccgtcggtggtgcgctccagggccagggcgacgcccttgtgctcgatgcggcggacttcctgggcggcgacgaaggccttggcgtcgtccacggcataggggtggggaatggcggcggtgaggcgcaccacatcccagtcgcccagcagcgccaccagggcgtccaggtccttgtcgctgaccggccgcaggcgcagacgggccgtgagcaggggatgacccgcccagaccgtgcccggttcccggcaaccccgctccgccatgatgccgtctccgttcctcaggtccgataggacccattgatgtcgatatacgcgtgcgtcaggtcgcaagtatagacggtcgaccgtcccttgcccacgcccacatccacctcgatgacgatgtccttgcccttgaagtgggcggccaccggggcctcgtcatagccgtgggccatttcgcccttgtcggccaccagcacgccgcccatgcggatggagagccggtcgcggttggccttctcgccggccttgccgacggcggcgaccacgcgaccccaattggcgtcctcgccggcgatggcggtcttgaccaggggggagttggcgatggacatgccgatggtccgcgccgccttcttgccggcggcgccggtcacgtggatggtgacgaacttggtggcgccctcgccgtcccggaccacctgcagggccaggtcgagcagcaggtcgaacagcttggccttgaaatcggccaggcgcttgtccttggcgtccttgatcaccttgttgccggccttgcccgtggcgaacagcatcagggtgtcgctggtcgaggtgtcggaatccacggtgatggcgttgaacgacttgtccacgcccttgctcagcaggtcctgcagcacctcggccggcagggcggcgtcggtgaagacgtaggacagcatggtggccatgtcgggcgcgatcatgccggcgcccttggcgatgccgttgatgatcaccgtggtgccgtcgatcaccgccgtgcggctggcgcccttggggtaggtgtcggtggtcatgatggcctgggcggcctccagccagttgccgggctgcagcttggcgcgcacgtcgcccagggcggcggtgatcttctcgtcgggcaggcgcacgccgatggtgccggtcgacgcgatgtagacctcggagtccttgcagcccaccagggcggcggtggactccaccgtgcgcttgaccgaggccacgcccaccgagccggtgaaggcgttggcattgccggaattgaccaccagggcgcgggccgagcccttggccacggcggcgcggcaccattccaccggggcggaggcggtcagcgagcgggtgaagacgccggcggccgtggtgcccttgtccatctcgaccatcagcaggtcggtgcgtccggcatagcgcacgccgcaggcgtggctggccagccggatgccggcgatgacgggcatgtcggggaagcgctcgggggcgaggggggagatggcggtggtcatggcgggaaatccgttgtcgcagggtaaaaggcccggccgttttcgacggccgggccattcaggcttttacttcttggccgcttcgagcggcgtgccgtcgggcttgaaccgcttgatcttggccttctcgcgcagttcgacgaccatcttttcctgcagttcctcggcgatctggcgggcgatcaccggcttggcctggtcatagggaggaatggaggccatccgcttgtcctcgaccttgatcacgtgatagccgaactgggtcttcaccggggtcttggacagctcgcccgggcgcatggcaaaggcggcggccgcgaattccggcaccatggcgccctggacgaaatagcccagatcgccgcccatggcgcccgaaccggtgtccttggaacgggtcttggccagttcggcgaagtccatgccgcggttcagatcggcgatgatcgaacgggcgccttcctcggtttccgccaggatgtggcgggcgtgcacttcttcctgcggctggaagttcttgacggcctggtcatagcggaccttgacggcctcgtcggtgacggcgccgcgcaccttcttctgcatcagggcctgggccatgagctggatctcgacccgcttcagcgcggccttgacgtcgggatcggcgtccagcttgtcgcgcttggcctgctcgtagaccagctggttgttgatggccacttcgagcaccgcctcgtagggggcctgggggcccatctggcggccgtattcggccagctgcgacatcttgatgtcggagccgttgacgttggcgacaacggaatcggcggcgatggccgggctggcggccagccctgccgccagggagagggcgagcatcgggcggcgcgcgaacagcatcttcatgagcgaacgttccttctcgtcgatggcccgggcgccaggagcggcgcccacggccgagacaacagtgcctgcggttgaaccacaaccggagggtcggcacaagtggtcgattggtatcaccctggaatgcggcaaagtcatggcggaattccgcgcccacccagcactggattcggaaccgactctgtgcaatatggttccccgacttcgcaggccagggcgcgccgccatacgcgcgcgccggcgccacccaatccaagcccccggccagggcgtgcctgtaagacgtcgtgtcggaccaagtggaggaaattatgactgttcgcgttggcatcaacggcttcggccgcatcggtcgcatggtgttccgcgccgtggcgaaggaattccccgagatcgagatcgtcggcatcaacgacctcctcgagcccgactacctcgcctacatgctgaagtacgattcggtgcacggccgcttcggcggtgacgtctcggtcgagggctcgaacctgatcgtcaacggcaagaaggttcgcctcaccgccgtcaaggacccggccgagctgaagtgggacgaggtcaaggccgacatcgtcatcgagtccaccggcctgttcctgtcggccgacgtggcggaaaagcacatcaaggccggcgccaagaaggtcctgatgtcggctccgtccaaggacgacactcccatgttcgtctatggcgtgaaccacgagaagtatgccggcgagaagatcgtctcggccgcctcgtgcaccaccaactgcctggcccccgtcgccaaggtgctgaacgacaactggggcatcaagcgcggcctgatgaccaccgtgcacgccgccaccgccacccagaagaccgtggacggcccgtcgtccaaggattggcgcggcggccgcggcatcctggagaacatcatcccgtcgtccaccggcgccgccaaggccgtgggcaaggtgctgcccgagctgaacaagaagctgaccggcatggccttccgcgtccccacctcggacgtctcggtggtcgacctgaccgtcgagctgaacaaggacgcgtcctacgaagacatctgcaaggccatgaaggcggcgtccgagggcgcgctcaagggcgtgctgggctacaccgaggataaggtggtcgccaccgacttcgtcggctgcaacatgccgtccatcttcgacgccgacgccggcatcgccctggacagcaccttcgtcaaggtcgtcacctggtacgacaacgagtacggctacacctgcaacatgctgcgcttcctgcagcatatcgccaagtaagcagccgacggcttgcgggcggaagggtctcccttccgcccgaattccattcagatcatcaagggggcagtcatgttccggaccatcgacaagctggacgtccagggcaagcgggtgctggtgcgcgccgatctcaacgtgccggccaaggacggcaaggttaccgacaccacccgtatcgaccgctcggccgccacgctgatccagctggccgccaagggcgccaaggtcatcgtgctgacccatttcggccgccccaaggggcgcgaggacaagtactcgcagaagctgctggtcgagccgctggccaaggccgtgggcaaggcggtggcctgggccgacgactgcatcgggccggacgtggaaaagctgatcgcctccatgaaggacggcgacatcgcgctcctggaaaacgtccgcttccatcccgaggaagagaagaacgatcccgccttcgccaaggcgctggccgcgctgggcgacgcttacgtcaacgacgccttttccaccgcgcatcgcgcccacgcctccaccgaggggctggcccatctgctgccggccgccgccggccgcctgatgcaggccgagctggaggcgctgggcaaggcgctggaagctcccgagaagccggtggccgccatcgtcggcggcgccaaggtttccaccaagctggacctgctgggcaatctggtgagcaaggtggactacctgatcatcggcggcggcatggccaacaccttcctgttcgcccagggcaagcaggtgggcaagtccctatgcgagaaggatctggccgacaccgcgcgcgcgatcctggaaaaggccaaggaggccaagtgccacatcgtcctgccggtggacgccgtggtggccggcgagttcgccgagaacgccgccaatgaggtggtctccgtcgatgcggtgcccgccgacaagatgatcctcgacgccggtccggcctcggccgaggccatcatcgaccgtctgggcggctgcaagaccctggtgtggaacggtccgctgggtgccttcgagatcgctcccttcgacaaggccaccaatgccgtcgcccaatgggcggccgagcgtaccctgcagggcaagctgctgaccgtgggcggcggcggcgacaccgtttcggccctggccaaggcgggcgtggaggagaagttctcctacatctccaccgccggcggcgccttcctggaatggctggaaggcaaggagctgccgggcgtggccgcgctgcacgtccagcccgaacaggtgcgcggcaccggctgcggctgtggcgccggtggcgccggcggctgcggctgagattgaagcctgccattcttcatcgtcacccccgggcttgacccgggggtccatggatggccgggtcaagcccggccatgacgattttcaggggtagtccatgaccgttcatttcatcggtgccggccccggcgctcccgacctgatcaccgtgcgggggctgaacctgatccgccgctgtccggtggtgctttacgccggttcgctggtgccgcccgagatcgtggccgaggccatgccgtcggcccaggtggtcgataccgcgccgctcaatctggacgagatcatcgccgagatggccgaggcccatgccgggggccatgacgtggcccgcgtccattccggcgatccctccatctatggcgccatcgccgagcagatgcgccgcctggacgcgctgggcattccctatgacgtgacgccgggcgttccggccttcgccgcggcggcggcggcgctgtccaccgaactgaccctgcccgacatcagccagacggtgatcctgacccgaacctcggtgcggtcttcggccatgcccaacaacgaggatctggcaacgctaggcaaaagcggcgcgacgctggccatccatctgtcggtcagcaatctggcccatgtggtcaaggagctgtcgcccctttacggcgcggactgcccggtggtggtggccttccgggtgggctggccggaccagagcttcatccgcggcacgctggccgacatccgcgacaaggtcaaggcggcgggtctgacccgcaccgccctgatcctggtgggccgcgtgctgggcggcgccgagttcaccgattcccgcctgtatgccgaggaccacacccacgtgctgcgccccgcgaaggggtaagactcgggccaaacaacgtcctatagtacgggccaccatgctcgacctgcctttcgatcttcccgaatttgttcccggctccgtctggctggcaggcgccggtcccggcgatcccgggctgctgaccctgctggccctgcacgggctgcgcggcgccgacgtggtgattcacgacgccctggtggacccgcgcatcctggcgctgattcccgccgcgacggcggtggaatccatgggcaagcgcggcggcgaggccgcgtccaacaagcaaagcgacatcacggcgcggctgatcgagctggcccgggcgggcaagagggtgttgcgcctcaagggcggcgatcccttcgtcttcgggcgcgggccggaagaggccctggccctgatggcggccggcatcgccttccgcgtcgtgccgggcatcaccgccggcatcggcgggctggcctatgccggcattccggtgaccgccaaggagaccaattcggcggtggccttcgtcaccggccacggccccgacggggatcttcccgacgcgttcgactgggatgccctggcgcggggtgcccctgtcctggtgttctacatggggctgaagcatctggaccgcctgaccgcgcggctgatggcggcgggacggcgaggcgacgaggcggcggccctggtctgcaatgcggcgacggaacgccagaccgtgctggagaccaccctggccgaggcggccggggcggtggagcgggccggcctcaagccgcccgccttgttcgtggtcgggccggtggtggagttgcggcgccagctggactggtgggctccatgatcgaggtcatcaccgatctcgcccatgcgggcctgggcatctgccgcgtcggcatcgacggcaacgagaatctgatcctcggcctgttcgtcaccgggctggtgggcagtctgacccattgcgtcggcatgtgcggccccttcgccctgtcccaggtggcggcgcggatggaggccattcccttcgagcgcatgaccgagatgcggcggctggccggggcggcgctgctgccctatcatctgggccgggccaccacctatggcgccctgggcgccgccgcggccggcttcggcggcattctgggcggcgccgggtcgttccgcctgctggcggcggtgctgctgggggtggcggcgctgctgctgctggccatggccttgcccgggatcaaggcgctggccggttcgggcggcgacagtcgctgggcgcgcggcgtgggccgtctggccgggccgctgttcgcccggccgttcgggctgcgcggctgggcgctgggcgtcatgctgggcttcattccctgcggcctgctctatgccgccctggcggcggcggcggccgggggcaatgcggtggccggggctttcggcatgctggccttctgggccggcaccgtgcccatgctggtgctggtggcagcagtgggacaggcggcggtgtcccattggcgggctccgctgttgcgggcggcgcccgcgttattggttttgaatgcgggaatgctgggcttcatggcctggcagcttctcgcctcgtgaacacggagagacttgcatgaagttctcgcgcagcctgctggccctgatggcggtgatcgtcatcgccttcgtggtgatcggtgtccgcctggtcatctggagcggcaacaattcagagggcgccaaggccattccggccatcggcggtcccttccagttgaccgaccataacggcaagcaggtcagcgatcgcgatttccgcaatcgctacatgctgatcttcttcggctacaccttctgccccgacgtctgcccgactaccctgtcgacggtgacggcggccatggagaagctgggcaccggctacggcaagaaggtggtgcccatcttcgtcaccatcgatcccgagcgcgacaccgtggcggtgatgaaggaatacgtgggagccttctcgcccgatatcgtcggcctgaccggcacgccggacgagatcgccaaggtggctaaggaattcaaggtctacgccgccaaggtcaagggcgaccggcccgagcattacaccgtcgaccactccgccatcctttacctgatggggccggacggcaagttcgtcgcccacttcacccacggcatctccgccgacgatctggcggccggattgaagaagcacgttggctgagggtaaggcgggggctgagaataggggcggggctgggtccaaggggctgatcatcgccgcgccctcgtctggcagcggcaagaccaccctgacgctgggcctgctgcgcctgctggcccgcaaggggctggcggtgggctcggtcaaggtggggccggattacatcgaccccgccttccacgccgccgcctcggggcggccctgctacaacctggattcctgggccatgcggcccgagagtctgggcgccctggccgccagggcggcgtcgggggccgaactgctggtctgcgaaggcgtcatgggcctgttcgatggcgccttcgtcccggcggggcagcctgacggcagcaccgccgatctggccgccgccaccggctggccggtggtgctggtcatcgacggacgcggcatgaccggttcggcggcggcggtgctggccggcttcgcccatctcaggcccgaagtgcgcatcggcggggtgatcttcaaccgggtggtgggcgacaagcacaaggcggccatcgcggcggcttgcgccagggcctgtcccggcatcagcctgctgggcttcctgccgccgtcgtccgggctggagacgccgtcgcgccacctggggctggtccaggccgccgaacgcgccgatcttcagacttttctcgacggcgccgccgccctggtggccgagcatgtggacgtggacgggctggccgccctggcccaaccatcgcgtctggccggcgggagtctgggggccatgatcccgcccctgggggcacgcatcgccgtggcccgcgacaccgctttcgccttcgcctatcccgccctgctggagggctggcgtcaggccggggcggaactgtcgttcttctcccccctggccgatcaggggccggatgaggccgccgacgcggtctatctgccgggcggctatcccgagctgcatgccggtcggctggcgggcaatgccgggttcctgaacggcttgcgccgcgccgccgccgctggggcggtgctgtacggcgaatgcggcggctacatggtgctgggccgcggcatggaggatgcccaaggcgtccgccacgccatggccgggctgttgggcctggaaacctccttcgcccggcgccggctgcacctgggctaccgtcgggccgccctgtacgccgctggtccgctgggcgaggcggggcagggctatcgcgggcacgaattccactatgcctccgtcctggcggaacagggggcgcccctgttctcggtggccgacgcgccgggggcggatctgggccatgccggactggtcgaggggcgggtgacgggctcgttcgttcatctcatcgaccggtttgccgggtcttgaacttgctgcggcgcagcatgaaatgaatccctggtcaaggcgaattctgcatcacagtgcagaataattttgttgcttggattgtcatcggcctgtaacaaaaaaccacgccaccgttccaaccagcctgggatcgacggatatgctctatcacctgcacgaaatgcagcaccacgctttcgcccccatgcgcatgctggccgaggccatgcagtcggtctacagccatccctgggtgcccatggcctataccaagttcggccgcacggtggcggccacggccgagttggtggagcgcaccaccaggcgctaccccaagccgcccttcaacctgcacagtacggtggtggacggcgagacggtgaacgtggtcgagcaggtgacccatcacacgcccttctgcaacctgctgcatttcaagcgcaacgtcgaagggcgcaacgaccccaaggtcctgctgctggcccccatgtcgggccacttcgccaccttgctgcgcggcacggtggagaccatgctgcacgagcatgacgtctacatcactgattggatcgatgcccgcaacgtgccgctggcccagggcaatttcaccctggacgactatatcgacctgctggtggaattcatggaggtcctggggccggatacccacgtcatggcggtgtgccagccttcggtgcccatgctgtgcgccgtgtcgctgatggctgcggcgggcaatcccaaccagccgcgctccatgctgatgatgggcggtcccatcgatacccgcatcaatcccaccaaggtcaacgacgtcgccacccacaagccccattcgtggttcgagcgcacggtgatccattcggtgcccatgaactatgccgggcacggccgcaaggtctatcccggcttcctgcagctgcacggcttcatgagcatgaacctggagcgccacgtgggcgagcacgtcaagctgttccagaacatggtcaagggcgacggcgattccgccgcccagcaccgcgagttctacgacgagtacctgtcggtgatggacctgccggccgattactacctggaaaccatcggcaaggtgttccaggagcatcacctgccgcgcggcatcatggaatcaaggggccgcaaggtcgatcccggcgccatccgccacacggcgctgatgaccatcgagggcgagaaggacgacatcaccggcgttggccagaccaaggccgcccacgacctgtgctgtaatctggcgcccgagaagcagcgctaccatttgcagcccaaggtgggccattatggcgtcttcaacggccgccgctggcgtgaagaggtctatcccaatgtccgcgagttcatccgccaacacgacaaaggctgattccgaagcggaaggtccgccgttctggcggaccacgccgctgtcggccatgacgcgggagcagtgggaatccttatgcgacggctgcggccgctgctgcctgcacaagctggaagacgccgacaccggcgagatccactacaccaacgtggcctgccggctgctgaacctgcacacctgcggctgcaagagctatgcgaagcgctgggactcggtgccggactgcgtcgagctgagcccggtggtgctggccggcatcaagtggttgccgtccacctgcgcctaccgggtgctgtcggagggcaaggtgctgcaatggtggcaccccctggtctcgggcgatcccgagagcgtgcaccgcgccggcatctcggtgcgcggcaaggtcatcgccgaatcccgcgccgacctgctggactatcatgtggtgacctggccggaatagcccggagcgccgagcatcaagtggacgttcggcggattagggctattcgctcccaaggggcgccgctcagcccaccatgcgctgggagggaagggaggcttcccgccgccccatgtggccgatccagcgccgggccaggttgaccagggcgcgacgctccagagcctctggcttgccgccccgccagccatccagcaggcggcgggccgaggcgatgatggccatgtgatcgccttgggggacctcgtcgcgggcgaaatgggcgacgatggtgcgcaacagggtttccagcgccatctccaccaccacgggcggcgcgccgaccgagcgggcgacatcgatctcgttgaggaggctgatcacctgccggtgctccgcatccacccgggcatggcccaccgagtatcgattgtcccagatcgcgatcatccccattggtccccgaatttaccctttgttaagagtgactcgggaagcccgcaatgttgatgggggtaaatgggtagggggatggcccgcccggaggagggggaggcctcctccggcttagggctcttatactttcggctattcggcggcgttgacgcgggtccggcccaccggatgggcgaggcgggacagcatctccttgggcactacctgccagaagcgcggtacttcgcggtcccagtcggccagcagggattccgcccaggccgagccggtgacggcggcgtgttcctgcaccagggccttcagcaccccttcccaatggggcgtctccagccgttgccagatgacgctttccggattgacgcgcttggcgaagctttcgtcggaatcatagacgaaggccatgcccccggtcatgccggcggcaaagttggcgcccaccggccccaggatcacggcggtgccaccggtcatgtattcacagccgttggagccgcagccctcgatcaccgtctcggcgccggaattgcggacggcgaagcgctcgcccgcctgtccggcggcgaacagcttgcccgccgtggcgccgtacagcaccgtgttgccgatgatggtgttctcgttgcttttcaactgggaggccaccggcggccgcacgatgatggtgccgcccgacaggcccttgcccacgtagtcgttggaatcgccgaacacttccagcgtcaggccctgcaccgcgaaggcgccgagcgactgtcccgccgagccgcgcaggcgcacggtgacgtggtcgggcgccaggccggtcatgccgtggcgcttgaagatcttgtgcgacagcttggtgccgatggcgcgctggacgttccgcacgttgtagtccagctgcatcttctcgccgtcttccagggccggcttggcgtcgatgatcatctgggcgtccagggtgtcggggacctcctgggtcttgtcctcgacgcaatagcgggggaagccgccggtgtcggcctgggccagcagcgggttcagatctaggtcgtccagatggctggcgccgcggctgacctgatgcagcaggtcggcgcggccgatgacctcggcgagagaacgcacgcccagcgaggcgaggatctcgcgcacatcttcagcgatgaagctgaacagattgaccaccttttccgggttgccggtgaacttctcgcgcaagctcaggtcctgggtgcagacgccgaccgggcaggtgttggaatggcactggcgcaccatgatgcagcccatggccaccagggaggaggtgccgatgccgaactcctcggcgcccagcatggcggcgatgacgatgtcgcggccggtcttcaacccgccgtcggtgcgcagcttcacccgatggcgcaagcggttgagcgtcagcacctgatgggcctcggacaggcccagctcccagggcaggccggcgaacttgatggaggtctggggcgaagcgccggtgccgcccacatggccggagaccaggatggtgtcggccttggccttggccacgccggccgccaccgtgcctatccctgagcgcgacaccagcttcaccgtgacgcgggcgtgcggattgatctgcttcaggtcgtagatcagctgggccagatcctcgatggaatagatgtcgtggtggggcggcgggctgatcagcatgacgccgggggtggcgtggcgcagcttggcgatctccaccgtcaccttgaagccgggaagctggccgccctcgccgggcttggcgccctgggcaaccttgatctcgatctcgcggcacatgttgagatattcggcggtgacgccgaagcggcccgaggcgatctgcttgaccgccgaattggcgttgtcgccgttgggacgcgggcgatagcgctcgcggtcctcgccgccctcgcccgacaccgacttggcgccgatgcggttcatggcgatgttcagcgtgccgtgggcctcgggggagagggcaccgagcgacatgccgggggtcaggaagcgcttcctgatctcggtgatgctttccacctcgtccaggctgatgggagcgccggcgggcttcaggtccagcaggtcgcggatggtgatgggcggcagcttgcgcatgccgtccgagtacttcttgtaggtggcataggagcccgtggccaccgccatctgcagcagatggatcaggctgccgtcgaaggaatgggcctccgagccgcgccgcacccggtagaagccgccgatgggtagggccggagccggaccggcgaagccggtggcgtgctgctcgacggtcttcttctggatgccggagaggccgatgccggaaatgcggctggtcatgccggggaagaactcggccaccagggtacgcgacaggcccaccgcctcgaaattgtagccgccgcgatacgagctgaccaccgagatacccatcttggccatgatcttcaacaggccctggtccagggcgtacttgtagcgccgcacgcattcctccagcggcatggagccgaacagcccccggcgctggcggtcggcgatggcttcctgggccagataggcgttgaccgtggtggcgccgacgccgatcagcacggcgaagtaatgcacgtccaggcactcgcccgagcgcacgttgagtgaggtccaggtgcgcaaggacaggcgcaccagatgggagtgcacgccgcccgccgccaggatcatcggaatggcggcgcgggattcgccgatgccttcatcggtgaggatcaggtgggtgcagccgccgcgcacggcttcttcggactcgcgccgcacccgggccagggcgtcgcgcagggcctcgatgccgcccttgggatcaaaggtgcagtcgatggccgccgccgcctcgcccatatacttgcgcatggcggcgaattcggcgttggacagcaccgggctttccaactgcagcaggtcgcactggctctcgtcctcgtcgaggatgttgcccaggttgcccaggcgggtgcgcaggctcatcacccgcgactcgcgcaagctgtcgatgggcggattggtgacctgactgaagttctgcttgaagaagtggtgcaggccgcgatagccggccgacagcaccgccagcggcgtgtcgtcgcccatggagccgatggcctccttggcgtcctcgaccatgggatggaggatcagctccatgtcttccatggtcatgccataggcggcctggcggcggcgcaattcgtccgacgacagctcggccggttccggcgccccggtcctgaccagggtgtccagttcggtgatgcgcttgacccaggccgagtaattgcggcgcgaggccagcaggtccttgatctcggtatcgcgatagaacttgccggcgtcgaggtcgatggcgatgctctggccggggccgacccggcccttctccaccacgtcgcaatccttgaccttcaccatgccggtctcggagccgaggatcagcaggccggtcttggtgatggtaaagcgcatggggcgcaacccgttgcggtcgacgcccgccaccgcccattggccgtcggtggcgcagatggccgccgggccgtcccagggctcgatcaccgagttgcagtagccgaagaaggtgcggtgcgcctcgggcatcagggcgttggagcccaggctctccgggatcagcatctgcttgaccagcggcgccgggcgcccggcgcggcacatgacctcgaagacgttgtccagcgcggcggagtcggaaccgcccggctggacgaccggcttcaggtcatccatggcctgcccgaacacctcgtgctccatgcgcggctcgtgggccttcatccagttgatgttgccggtgagagtgttgatctcgccgttatgggccagcatgcggaagggctgggccagccgccaggtggggaaggtgttggtggaatagcgctggtgatagatggcgaagcgcgacacgaagcgcttgtccagcaggtcgggatagaagctggtcagctgctcggccaggaacatgcccttgtagatgatcgagcggcacgacagcgagcagatgtagaagtcgttgatgtggttgcccagcacccgcttctcgatgcggcggcggatgacgaacagatcggcctcgaaccgctcttcgctggtgcccagcgtgttggcgatcatgatctgctcgatctcggggcgggtggcgttggccttctcgccgatgatcgacacgtccaccggcacctggcgccagccatagatggaatagccgaaattcagaatctcggtctcgacgatgcagcggcagttctcctgggcgcccaggtcggtcttgggcaggaagacctggcccaccgccagccgcccttcggccaccgcgtgtccggtgcgggccacgtggtccttgaagaagtcctgggggatctcgacatggatgcccgcgccgtcgccggtcttgccgtcggcgtccaccgcgccgcgatggaacagcacggacagggcctggatgccggcctcgaccacgtcgcgccggggcttgccgtcgagcgccgccaccatgccgacgccgcaggcgtcatgggggctggtgtcgataccggcggcctccaggatctcctggttggcgaggtattgggagacgaaatcggacatggggcgcactcctactccgccgcctgggcggatttggcactgacgtagcggtggatggcttcggcggcgtcgcggccgtccttgatggcccagaccaccagggaggcgccgcgcacgatgtcgccggctccgaagacgccgggcaggctggtcatcagcgtcgcgtcggtctcgacggttccccatttggagaccttgagctcgggggcgccgaacaggacgggcatatcctcgggatcgaagcccagggcggcgatgaccatgtcggaggccaaggtgaagcccgatccctcgatggccaccgggctttgacggcccgaggaatcgggcatgcccagatgcatgcgcacggcccggacgccctcggccttcttggcgccggtgacggcttcgggggcggccatccagacgaattcgacgccttcttcctcggcgtgggccacctcgcgcttggagccgggcatgttggcccggtcgcggcggtagaggcacttcaccgacttggccccctggcggatggcggtgcgcacgcaatccatggcggtgtcgccgccgccgatgaccaccacgttgcggcccttggcgtccaactcggccacggtctcgccgagatcgcggcggttctgggcgatcaggtagtccagggcggcatgcacgccgggcaggtcggcgccattgatgcccaggggcttggccttgtagaccccggtggcgatcagcaccgcgtcgtggcgggcgcgcagttcggcgaaggagacggtcttgccgatttccacgccggtctcgaacttgacgccggcctcggccagcaggcggatgcggcgctcgaccacgtccttctccagcttgaagccgggaatgccatagatcagcagcccgcccatgcggtcgtggcgatcgtagacggtgacggcatggcccttgcggcgcagggattccgccgccgccagtccggcggggccgccgccgacgatgccgaccgagcggccggtctcggcgccgggcagcaccggcttgacccatccttcagcgaaggcggtctcggtgatgtgcttttccaccgcgccgatggtgacattgccgtgggtggattgctccagcacgcaattgccctcgcacaggcggtcctggggacagatgcggccacagatctcggggaaggtgttggtggccgacgagacggcgtaggcctcctccatgcggtcctgcgccaccagcatcagccagtccggcacgttgttacccagcgggcagtgaatggagcaaaagggaatgccgcattgctcgcagcgcgacgcctgctcgcccgcctgggacgccccgaaggcggtgctgatctcgccgaaatccttgcggcgctcggcggcgccgcgcttttccggctggcgctgatggaggtgggtgaactgcagcatcttgcggggcatggctgttcctcgagcccgggaattgtcgggcgaaaatacgtcagaagtggtgaccaatcaatgggaatcgcgcaaatgagacaacattgctgtctcaaatcaaggtctcgtgccgaagtgcggctgcgctcgagaatatggggtggcgctcctgaatataattgtcccgtttcggacctttccgtttctcttccggcccggcgggtccggtgctataaccatggcagccgcatacggggggcacccgagtgacgttcctagaagtcctggtcgtggccctgattcaggggttgggagaggttttgccgttcggagccgccggtctgctggcggcgctgccccatctggctgccaagcccgaggggcgggccgcgctgtcggtggcggcccatgccggcattttgctggccctgatgatctatttctggcgcgacgttctggccatggccgtcggtctgtggcgtctggccaagggcaagcccgattacggttcccatctgctgctgcacgtcctggccgggaccatccccgccgccatcgtcggttggctggtgcttgaccgcgcctcgaccctggtggggcagagcggcgcggcgatcatcctgatcctcggcggcgttctgctgtggggctgcgacaaactgggcgtcaccgtccgccgggtcgagcacatgagctgggtcggcgccgccggcctgggggccttgcagattctatcactggtgcccggcgtgtcgcgcaccggcatcaccgtcaccgtggctcggctgctgggatgggaacgccaggcggcggtgcgcttctccatgctgctggccatgccgctgatcctggggcatggggtcaagaccttctgggggctggcccatcacaccgaactggtgttctccagcgacctgctgatggccatggccacggcggggctggccgcgctgatcggtctggcgggcatgatggcctgggtggcgcgcaataccttcgttcccttcgccatcctgcgcatcggcttcggaattgcggttctgggcctggtctatttcggccaggcctgaccggggcttatgccagatccccatgagccgaactcatcgggaccgccctcaagcggcgggcggacgctgtgcgtccttgccttccgccgcataagcggcgcggccccttgggcctaaccaaatccccataagccgaactcatcgggatttggtattaccgtccgaagatccccttcagcaggtcgtcgatggcgccgccgatgcccttggccgcgtcccccgccgcttgggcggccccggccacgaagtcgccgacgctttcggctggggaggattccgccggaacctccggggtgcgcagcggccgggcaggcaggccgcgatgggcggcggtcatcacctgcttccacaattgggcgggcaggccgccgccggtgaccttcttcatctcgatgcggtaatcgtcgttgcccatccacacgccggccacgtaatcggcggtgaagcccatgaaccaggcgtcgcggtaatcctgggtggtgccggtcttgcccgccaccgggcggtccaggcgggcggccttgcccgagccctgggtgacgacggcgctcatcatgtcgtgcatgcgcgacagcgccgccggtgacaccacctggccgaagccgccgccctggcgctgatacagcactttgccggatgggtcggtgatgtgggagacgccgaaggacgtcaccccatagccgccattggccagggcggcataggcggtggtcagctccagcagcgagacctcgctggtgcccagggccagggtggcgtcgttgcgcaggtccgaggtgatgcccagccggcgggccgtggcgatgacccggccgggacccacttcctccaccagccgcacggcgacggtgttgaccgattccgccagggcctggcgcagggtgatggggccgagatacttgccggtgtaattgccggggctccagttgcccaggcggatgggcttgtcctccacctcgtcgtcgggggtgcggcccatttccatggcggtgagatagacgaagggcttgaacgacgagccgggctggcgcagcccctgggtggcgcggttgaactggctgtcgtcgtaatccttgccgccggtcagcgcccggatggcgccgtcggggctcatcaccaccacggcgccctgggaggcgttggccttggcgccgggcccggccatcatggtcttgaggtcggcctcgaccttgcgctggagcgcgatgtccatggtggtgtgcaccacgatgtccttgccggccacttcgccgaactggtcgagattagccatcagccagtcggcgaaatagcggccggcgggaatggggcggcggaccagctgggcggcgccggtcacctggacattgtcggcggtcttctggtcgatgtagccggccttgaccatgttggccagtacgtcgctggtgcgcttgcgcgaggcctcggggtcgttgagcggcgaatagcgcgagggagccttcagcaagccggccagcacggcggcctgatagacgtcgaccttgcgggccgagacgtcgaaatagcgcttggcggcggcgtccacgccgaaggtgccggacccgagatagacccggttgaggtaaagccccaggatctgctccttggagaagcgcttttccagccacagcgccatcagcacttcctgcaccttgcgcttcatgttgcggtcaggcgtcaggaacaggttcttggccagctgctgggtgatggtcgagccgccttgcaccgtgtgcccggccctcaggttcacgaatagggcgcgggcaaggccgatggggtcgacgccccaatggctgtagaagcgccggtcctcggtggccagcaccgcctgggcgatgaagggcgacatctcgcccaggtccagcggctcgccgtagaggtcgccataggcggcgaagatctcgccctccaccgactggaacaccacactggggcgcctggtctgggcggtcatgcggtcgatgtcgggcaggtccagggcgtaataagccaccacgccggccaggccgatgccgatccagatggccagggtcaggccccagaccagcaggcgcttgccccatttgcggccattgcccgagccgcccttcttgggcgccttgggcttttttggctccttgggggcgcggccacgcggcggcggcggctcacgcgggggcgggggttcgcccccggaaccgctgggcaacagccggtcggccgggtcgatggagagcttgaacggattgccggcacccttggggcgcgagggaggaactgccatggggccttctaccacggggtgggggctgctcggaactggcaacatccgttcattggatgtagagtcccggctgaatgtttaacgaggaccgaaccatggaaaccctgtcgattgccgttccgcccgaactgaagcagcgcctcgaggcgttggccgccgagaccgggcagacggtgggggagtgcctggccatcgcggtcaaggaatacgtcgagaactgggaaacccacctctccgacgtgcaccagatcgacgagcacgaggcccgtgccgtgctgaaggccgtggtcaacgactagcgccattgctgcgctccaacgcaaaacgccgcccgatccgggcggcgttttcgtttgtgggcctggaatgtggccgaagtatgaaacgcctgtcattccgagcgtcgcgaggaatctccgcttgctccgtcgccgccaatttggacgcgccgtgccaggacgagatccctcggctacgctcgggatgacaattcctattcgccggtggcgatgcggtccaccagttgcttgacagtcgggatgaagccgttcttgtagaagggatcggcgccgaagcgataggcgttgtggccggcgaacatcagttcgttttccacgtcgccgccatggccgatgttctgcagggtcttctggatacagaagctgcgcgggtcggccttcttgccggtggtcccggcctcgttctgagcccagttggagaacatgcactgggacaggcagcccatgcacttgacctgatcgacgcggatttcctcggccttgtcgggggtgacgaagatcagggtcgaatcgggggtgcgcagcgcctcggtaaagccctcgttcatccagcccagcgcccggtcgcggtcgtggggtgtgacccagacgatgcgcttgcgggcgccgatgggcagctcggcctcgtgatcgccgacgcattcgctggaataggggatctggtggtccagccgctggcacagctcgttgatgaagtcgttcttcaccgccgaggagtagaagccggtggggctgaaatggtgcagcagcacgtcgccgggcttcagcgtcagcaggcgctgcttccaggcgtcggagatggggctttcctgggtcagcagcggacgggtgccgtactggaaggcgatgggacccagttcggggttgccgatccagtcctcccattccttcagccaccagacgccgccggccatgaagatcggcacgttgcccaggccgcattccaccatggtcttgcgcagctcggcgacgcggccataggggggctcgggcttcctcgggtcttcggaattggacaggccgttatggccgccggccagccaggggtcctcgtagaccacgccgcccagcaattcgccgtacttgtggtaggcacgcttccacagggcgcggaaggcgcgggccgacgacacgatgggatagtaatagacgttatagcgggccgcgatctcggccacgcgatagggcatgccggcaccgcaggtcacgccatggatcaggcccttggcgccgtccagcacgccttcgaggatctgctcggcgccgcccatctcccacagcacattcatgtggatgcggccattgccgccggcgatgtcgtgggcgatgcgggcctgggcgatgccgcccctgatgccgtaggcgatcagctcgtggtgtttctcggtcctggtcttgccgtgatagaccatgtcgatgcggttgccgttctcgtcatagagatcggcattgactccggagaaggtggcgacgccgccggcagccgcccaggcgccagaactctcgccattggagacgttgatccccttgccgccctcgaccaggggcaggacctcgcgaccggaaatcaggataggatcgagcgctttcacgtcaggggtaactcctcggatggctacgacgggctctcccaggcctgccgatgacggcacatatatagccctttgtcgtgccgcgccacagtgacgttacggactcatgacgaatgaggaaaatcggcgaagacggcggcgacgccccagtggcccaagatccgggcgcgggccgggtcgttgaccgtataggcccgcgccggcaggccggcggccatgatgccggtcaccacgtcggcgtccagggtacggtggtcgaggtgcagcgcggacgcctccagccgtgtagcctgctcgcgccagtcatcgggcagcgcctcggccagcaaagcgcggggccagtggggggcgacgcgccgggcaacgtccagacagatggtctcaaagctggagatcaccggcgccgatacgctttcgggccacaggcgaagggccagggccagcgccgcctcggcggtctcggcctcgcgcccctcgtcgggcttgatctccaggttgatccccagccccaggtccaggcagaggcccagcacctgctccaggctgggcacgcactctccggcgaaggcgggggcgaaccacgatccggcatcgagcccggcgatttcggcccagttgcgctccgccaccgggccggtgccgctggtggtgcgctccagggtgtcgtcatggaagaccagcggcacgccgtcccgggacaggcgcacatcgaactccaccatggcgaggccatgggcggcggcggtcctgaacgaggccagggtgttctcgggcgccagcccggccaggccgcgatggccgatcagcatcatcccagcaggcgcttgaccgcgtcgaggacctgctccaccgaaatggcccgcatgcacgcggcgtcggtgcaggcggtgctgcggtgattcatggccgagacgcagggcgagcaggccagccgggcggtgatgaactcggccttgtgattcagggcgccgtagagggcgggggtctcggggccgaacagcaccagggtgggcaggcccaccggcgcggcgaaatgggccgggccggaatcgttggtgaccatggctcgggccagggcatagaggggaatcagatcctccatgcgggtgaagccggccagattgcaggcgcggttcgagccggtggcgtccaccagccgctgggcctcggccttttccgaggccacgccggtgacgatgacggccaggccctcgtcctcggccagcaggcgccgcgccacctcggtgtagcggtcatagggccagcggcgcagcggcatcagctcgctgctgttgggattgaggatcacccagcgcgtcgtctccttcagcaccggataggcctgaaacagccgggtcttgaaggcctccagcgcctcgggggcgggggccagcggcgccagcctcacttcgtcgtcggtgaaggcgaccttgccgtggggcgtggtgccctcgggctcggtcagggcatggaccagggccatgaagctcttggcgatgtgctggtgcgggttgtagcccacccggtgggtcagcaactcgccccgatagaggccctcggtgtggaagcggtgaaagcccacccgcttgggcgcccccgacaggaaggtcagcagcgccgagaagcgcgagaacatctccatgtcgatggtggccatcaggtccagcgaacgcatggtgcggatcatgcgcagggtgtcgacgaccagggtgaccaggctgtcggcgcggatggtcagcatgttctcgcgcgcgatggtgcccatgatgtccaggctgggacggttcttggcgaagatcaggaaatagaccctggcgtcggggaacagcgcctgcgcccgcttcaaggccgcgtcggcgatgaccgcgctgcccatctccgacagttcgatgaacaggatgttcttgcccgcggacggtgccggcgggctgaagaaacagcggatccgccagtaaagggtgatcaggaacgcgaggggcacccccgcccagaaatcgatctgccgcatcctgtcgacgttcacgaccgcctcacttgttctcgaaggtgcccgagccataggactcggccagccagatttcgtaatggtccacgaccttgccgccccaagcccggtccaccgtggcaagcagggtcaggctgcggaacgagcggcgcacgtcctggacggcgtagaacccgtccttgatcacgtacaatccattctgccccggcaacgcggccgcgtcccgggcatcatacgaaggaattcggggaaagccagccgaaccagtcaggaaaaccaccggatggccaggcagatagtaggtcagcaacccggccacctcgtgcttggtggtgaagacgaaggcgtcgggatgccgggtccgctcagcctccaccgcgctggccaactggtcccagccgcccaggcggctcatggggtcggatttgagcgggatgggcaggcgggccgtctccatctgcacataggtggcggccaccagcagccctcccagggcgatggcgccatgccacagccagcgcagccgccgccaggagggggcgagaaccacccaggcccccgaagtggcgatggcggcgcccagataggccggacccggccagtggggctggaccacaccgcccaggctgtggcgcacgaaaaaggccagcagcggcgccgaggtggcgccaagcaggaaccaggcgggctgccggcttcgccatccggcccacagcgtccagcccatgccccacagcatgaagccgaagatcagcggggtgatcactcccaactgggtgccgacgaaggtggcgagactcttcagcggatcgctcaccggcgcgtcgaaggaatgggacaactgcttcttgatggagatccagtcgtgctgggcgttccagatcagcaccggcgaggtgcaggccagggccaggacgatggcggcccagaaatgcgggcttttcaaccaccgcctcgcctgggggaacagggcgaacaccgccatgatgcccggggcgatcagcaccatggtgtatttcgagcagaaccccagccccagcgacaggcccagcaggtagagccagcgcgcccgcccgtcgtccagcaggcggaccatggcccacagcgacagggaccagaacaccagcaacggcgagtccggggtgaccagcacgccggcggcggcgaacaacagggtggcgttaagcacggccaccgcccaccagccggcgcgaatgtcgcgaaaggccagccgggcggtgtcgaaggccaggccggtgacggcggcgacgctcagcacggcgggcaggcggatggcggcttcggattcgccgaacagggcggtggctccggccatccaccaggccatcatggccgggtggtcgtaataggacagctgcaggcggcgcgaccacagccagtaataggcctcgtcacccgacagcagggtggtgccggtcagccacagatgcagcagggcggcggcgaggaccagcccggccagcagggcggcatccctggttccgacggagggggctcgatgggactcggcgtcgggcgccacggggaactccgcctgcgggaatgatctgcgacgggccaatagcatgaaatgcccaccctctaccagtcgccaccttgccggggcggcggggcgccgctatacccaagggagattggatggaggaggtcccatgttccgcttcacgttcgccaggtcgctgctggtcgtttccgccgcctgcgccctgctggccgcctgtggcggtgagccctccgagtccgacatgaagtccgccgtcgagcagaccttcggcggcatgaacgagcaactgggcggcgtcggcaagctgatcggcaaggacctctccaccaaggtcaagagcttcaagaagctggcctgcgccgaagccaagggcaatcccggcttcgcctgcgatttccagatggtggtcgacggcccgctgggcgagaagaccgagaaggcctcggcccgcttcgtcaagggcgacaagggctgggccgttttctaggtatagggcgtcatggccgtatcaagcacggccatgacgccataagtcacgccaccttgggcgccgcctcggccaggatcgcccggatttccggcacgcacgagccgcaattggtccccgccttgagcatggcgcccacctcggccgcgctggacaggcggtggtcgcggatggcggcgcggatggcttccaggcccacgttgaagcaggcgcacaccgtcttgtcgcggccccggtcgccgccgggcggcgcgccggccaccagggtggcgcgctcgtcgccggcgatggcggcgcggccgaaggcggcggccacccagtcgggcgagaaatcggtggcccagggaaagacgaacagcaccgcatccaggcggccgtccaccagacgggcgccgcgatagtggccgcgattggggtcgaggaactcgatccattcgccgtcggcgcccagccattgcttggcggtgacgggccagtcctcgccggcttcgcccgccagccgccagatggagtgggcctgacccgccgccttggcccagtagaacgagcggggcagctctaccggattgcggctgagcagcacgccgtgccaggcggcgtccaggggctcgaccatcaccggggcctgcttcagttccggctggcccgagacgggatcggtggcggcgtcgattagggtgccgaccaccgcgcccgaactggtgcggtcgttccagtggatgggggcgaagacctcgcccgggcgctggccgttgtcgaaggcgatgcgcagaaccacgctggcccggcggccggagaccttggccagtcccccgtccgccagccggaagcggatggcgtcccggggatggacctgcagcaccggctcgggcgcgtgggcggccagccgagcggcacggccggtgcgggtcatggtgtgccactggtcgcgcatgcgcccggtgttgaggatcaggggaaaggcctcgtcggtggcccgcgctggcgggcggggcggggtgtcgaccatccgggccttgccatcggggtggtagaagcggccgtcggcgaacagccgcgccgtgccctttcccggttcgcgcaccggccactggatgggctcgatggactcgtaatcggctcccaccagacccgacagatccaggtcgcgggcgccatggttctcgaaggcggtcaggcggcagaactcgtcgaagatggcccccgtatcggtccaggcgaaggcctcgccaaagcccatgcgctgcgccacctgggccatgatccaccaatcgcccttggcctcgcccggggtggggaggaaggggcgctggcgcgagatgcggcgctcggaattggtgacggtgccctccttttcgccccaggtcagcgccggcaggcgcacatgggcgaggcgggccgtgtcggtgtcggcctcgcattcggagaccaccacgaaggggcaggcggcgatggcggcccggaccagatcggcctcgggcatgctgaccgccgggttggtgcacatgacccaaagggccttgatcttgctctcggccaccgccttgaacatgtcgacggccttgaggccgggcttggccgccacgcgctccgacgcccagaagcgcccgacccggtccacattggcctcgtcgaagcccatatgggcggccagcatgttggccagtccccccacctcgcgcccgcccatggcgttgggctggccggtcagtgagaacggccccatgccgggacggccgatgcggccggtctgcaggtggcagttgatgatggcatccaccttgtcggtgcccgacgaggattggttgataccctgggaccacaccgtgacggtcttttcggtctcggcgaaccacgagaagaactggacgatctgctccagcggcacgccgacctccacctgggcttcctcgcccctgaggtgggccagcagcccgttgaacaggatggcgtcggtgcccggccggatggccagatgcaggtcggcgcattcggcggtggcggtgcggcggggatcgaccaccacgatgcgcatgtcggggcgccgggccttggcggccaggatgcgctggaaggcgacagggtggcaccacgcggtattggagcctaccagcaccaccagatcggccagatccaggtcctcgtagcagccgggcacggtgtccgagccgaaggcgcgcacatgaccggccacggtggacgacatgcacagccgggaattggtgtcgatattgcccgagccgatgaagcccttcatcagcttgttggcgacgtagtaatcctcggtcagcaattggccggagacgtagaaggccacggaatccggcccgtgctcggcgatggcggcggtgaacttttccgccaccagatccagcgccggctcccacgccaccgtttgctccccgatcatggggtggagcaggcggccgtccaggtcgagagtctcggccagactggagcccttgacgcacaggcggccaaaattggcggggtgctcgggatcgccccgcactacccattgcgcggagtcatcaaggcgggcggcgatgacgccgcagccgacgccgcaatagggacaggtggtgcggacgatctcgggcatgtcagccatgggccacctttttcgcgctttcgagcttcagccagaccaggccgtcgaccaccttggaatccacgggccgcgtgcagccctcgtcgggggcggtggcttcgccggtctccaggtcgatggtccaggaatgcagcgggcagaccaccaccttgccggtgacgatgccctcgcttaaggggccgcccttgtgggggcagcggttgaacagggcgaagatctcgtcgtccctggtgcggaagaccgcgatgtcgcccttgtccgtctggacggtgcgggcccccagcctggggatgtcctcgacgcgtccgatcttgatccagtcctgcatggtcttagcccacctcggccagggttttgaattcgtgcgcatccacctcgcccgaggcccgttcggcccagggatcgatctgcgcgtagttctgcgagaagacgaagcgggcgaaggcggcgcggcggccttcggcatcctcgacgacgcgcttggtgatgtagtccatgccgacccgctcgacccacggcgcggtgcgctccaggtagcgggcttcctcgcggtagatctgcatgaaggcgccgcaatattcgagcacctcctcctcggaggtgacgcggaccagatggtcggtgccgcgcagctcgatgccgccgttgccgcccaccgagatgtcgtagcccgcctcgacgcagaccacgcccatatccttgatggtcgcctcggcgcagttgcgcgggcagcccgataccgccagcttgaccttgtgcggtgtccacgagccccacatcagcttctccagcttgacgccgaggccggtggaatcctgggtgccgaagcggcaccattccgagccgacgcaggtcttcaccgtgcgcaggcccttggcgtagccgtggcccgagaccagaccggccttgcccagcacggcccacacgccgggcagatcctccttcctgacccccagcaggtcgaggcgctggccgccggtgaccttgacggtggggatcttgaacttgtccaccacgtcggcgatggcgcgcagttcggtgggattggtcaggccgccccacatgcgcggaatgaccgaataggtgccgtccttctggatattggcgtgggcacgctcgttgatgaagcggctctggtagtcgtcgacgtattcactgggccaggcgcacagcaggtagtagttcagggccgggcggcacttggcgcagccgtcggcatggcgccagcccaaagcctgccgtaccgcgtcctgggtcttgagcccctggtgcaggatctccctgcgcacctcgtcgtgggagaggtcggtgcagccgcacatgccggcggccttggcgtccaccacctcgccggtgacgtgggtcaggatggcctggaccaccgaggcgcactggccgcaggaggccgaggccttggtgtgcagcttgacctcgtcgagcgaggtcagacccttctcggtgatggccttgacgatggcgcccttggacacgccgttacagccgcagacctgggcatcgtcactcgtggcggccacattgacgccgcccgcgtggcccttgcaggtggtatcggcataggcctggccgaagatcatgcggtcgcggatggcggccacgtcggccttttcgcggatgagctggaagtaccaggagccgtcggccacgtcgccgtacatcacggcgcccaccaccttgtcggcgcggatcaccagcttcttgtagatgccccgggcggagtcccgatacaccagctcctcgtcggcttcgtcctgggccgccagctgtccagccgagaacacgtcgatgccggtgatcttgagccgggtggacagtggcggggtctcgtaatgggcgtcgtcgcggcccgccagacgcgaggcgcagaccttggcctgctcccagatgggcgccaccagcccgaagatctggccgcgatgctcgacgcactcgcccaccgaatagatggcggggtccgaggtggccatgtcgtcgcccacctcgatgccgcggttgatgtcgaggcccgcggccttggccagatccacgttggggcggatgccgatggccaccaccaccagatcggcgggaatctcgcggccgtcggtgagcttgacgccctgggcgcgcccggtttcggcgcccatgatttcctcggtctggcccgaggtgaagaagtgcaggccgcgctcggtcaggtccttctgcagcaggccgccggcctccacatccagctggcgctccatcagggtgggcatcaggtggaccagggcgacgggcatgccgcgccgcttcaggccccaggcggcctccagacccagcaggccgccgccgatcaccacggcgcgctgcttggcctcggcggcgtccagcatcttctccacgtcggcgatgtcgcggaaggccaccacgccgggcaggtcaaggccgggcagcggcggcatcagcggcttggagccggtggacagcagcagcttgtcatagggcaccaccacgccattggccgaggtgacggtcttggcggcgcgatcgatggccaccaccgggtcgccggtgtgcagggtgattccgttctcggcgtaccaggcgcgcgggttgatgacgatgtcgtccacctgcttttcgccggccagcaccgaggacagcatgatgcggttgtaattggggtggggctcggcgccgaacaccgtgatgtcgtaacgggccggcgcgatggccagcagctcctcgacggtgcgcatgccggccatgccgttgccgatgacgaccagcttctgacggggaagagcgttcatgtgaggtctcctgattcggtctttgccgtcgggggcatggcggtggcgcgggatgcgaaggggtcgaaggtcccgccgcccagcagcaggtcgggccccatctcgatgggcctcgtggccttcaagaggttccagggggcggcgtggccgccctcggtcttgtaatcggtgagcggcacccgaagccccagcgccagggcggccacccggtagaggtcggggcggaacacggcttcggcggcggcgcgggagtccagggcgaagggcgccatgtcccagcgcttcatcatttccaggtaccacatggcctgggagcgccacgggaagttggcggcctgggcgtggaaggtcagcagggtcttgggcaggccgtgctcgcccagcagcggcgccagcagggcgtccacgggggcattgacgtattgcggctgggccagcagctcggccagttcgcagcgattgtcgtcgcaccagcgggcggcgctgatcagcgcctgcagcacggccagatgggtctcgggatgggtctcggcccaagtctgggtaaccgcgaagaccttttccagccggccggcgaagatgtcgccgctggtcgccgcgatgcggccgagattcatccgcaccgccaggctgccccagggctcgccgacgcagtatccgtcaatgttgcccgccgacaggaacgagatcatctggggcggcggcaccacggtgaaacgcacctcggcctgggtgtcgatgccggcggcttccatccacaggcgcagctcggcggcgtggggggagtaggggtagacggtggcgaaggtcatgggcggcttgcccacggcccggtcggcctcgatgacgcgtttcagggcacgggccgagaccggccgggccgccatggattggggatcggcggcctccatgcgctcccacagggcattcccgatggtgatggtgttgccgcccaggttcagcgccatgcccaccgccatgggcacccggatgggcgacaggcccaggctcatggccagcggcatgggggccagcatctgggcgccgtccagcgcgcccaccgccaccttgtcgcggatggaggcccaggacgcctcgcgggacagctcgacgtccaggcccatctcggcgaagaagccgcgctccttggccaccaccagcggggccgcgtcgatcagcggcacgataccgagcttcagacgggtcttttccacgctcatctctttcatccctcggccaaaacaaaaaaggcgttccgcggaaagcccggcgccggcccattggggggcagcgccgaattccgtggaacgcctttgttccgttgcccgtccgggtgcatcgttgcgtccggtgggcttttgttcagggcggctggggcctcgccattgaggccgttcgccgcgttcagtaaactcgcttcctgcgttgcacaccccatgccaagccggaaacggcggattgcctggggattgtccggataggtccgggtgtgtgcctaaaaaataaacagcacctcagctgcaggctaaaaaataatcacatcatgaggccttggcgtgcgcccccgtctcgtactcgtcgaggaagttcagcacttcggcgcggtactcgtagtaacgggggtgttccagcagggcgcggcgggtgcgcgggcggggaatgtcgacgttcagcaccttgccgatgcgggcattggggccgttggtcatcatcaccaccttatcggccagcaggatggcctcgtccacgtcgtgggtgacgcagatggcggtgacccgggtgcgggtccacacctccatcagcacttcctgcaattcccagcgggtgagcgagtccagcatgccgaacggctcgtccagcagcagcagcttcggcgacagcgcaaaggcgcgggcgatgccgacccgctggcgcatgccgttggacatgtccgacgctttcttgtccatggaatcgcccaggccgacccgttccaggtaataggagacgatgtccaggcgctcggccgggctggcatggggatagacccggtcgacgcccagcgccacgttctgcagcgcggtcagccaggggaatagcgacggcgcctggaacaccacggcgcggtccggcccggcttccgagacctcgcggccgtcgaggatgacgccgccctcggacacgtcggtcagcccggcggtcatggtcagcaccgtggacttgccgcagccggaatggccgatcagcgagatgaactcgccctggtgcatcttgaggtcgaagccgtccaccacggtcagcggacccttgggggtggggtagatcttcttgacgcgggagaattccacatagcggtcgggattgttgacctgaccggcctcgcggtaggccttgggtgggccgccgaagctgatgggggcgacgttgggcaggatgcgggtctcgccgctctcgccgccgcgctcgacgcccaccgccatcaggtattcggtgacctcggccctgaggcgcttgaagtcgggatcgctgttgacggcggcgcggtcgcgcggtcgcggcaggttgaccttgaacgagggaccgaaggtggcgcccggcccgggattgagggggatgatgcggtcggccagcagcagagcctcgtccacgtcgttggtgatcaggattacggtcttcttttcctgctcccagatggcctcgatctcgtcctgaagcttggcccgggtcagggcgtccagggcggacagcggctcgtccagcagcaggatgtcggggctcatggccagggcgcgggccacggcgacccgctggcgcatgccgcccgacagctcggacgggcggcgctcggcggcgtgggacaggccgaccatgccgatatacttggcgacgcgggccttgcgctcggccttggaggcgtcgggcatcaccgcgtcgacggccagggcgatgttgccctccaccgtcagccagggcatcagcgagtaggactggaacaccacgccgcgatcggcgccggggccgtcaaccggcttgccgcgcagcagcacctcgccggcatcgggcttgatcagcccggccatcagggagaccagcgtggtcttgcccgaaccggagaagcccaggatggcgatgaactcgccgtcctcgatctccaggtcgatatcgcgcagcaccgaggaggcgccatagctcttggcaacgcctttgagttcgaggatcggcatgacgtctctcctgatcaacgggtggcggagtgggagaacagggcctggcacgccagcatgacccggtcgagcaggaagccgatcaggccgatggtcagcaccgccaccatgatcttggccagggactgcgacgagccgttctggaactcgtcccagacgaacttgccgaggccggggttctgggccagcatttcggcggcgatcagcaccatccagcccacgcccagcgacagccgcatgccggtgaagatgaagggcagcgaggacggcatcaccagcttgcggatggtggtgcgcatgggcaggttcagcacccggcccacattcatcagatccttgtcgatggaggcgacgccgatggccgtgttgatcagcgtggtccacagcgaacacagggtcacggtgatggccgaattgaggaaggccttctcgaacatgggctcggcactggtataggaggccgagaccaccatggtgacgatgggcagccaggccagcggcgagaccggcttgaagatctggatcagcgggttcagcgcggcattgatggtcttggacaggccgcacatgacccccaggggcaccgccacgatggtggccagcacgaagcccatgaacacggtcttcaggctggtggcgatctggtcgagataggtgggcttgccggtgaacttgcggaccttggtctcggctccggcgtcctcggccttcagttcggcgttgcgcttggcctgacgttcgtagaacgccgcctccttggcgcgctcggcctggtggtcggcgaccaggttgcccacctgctcccacacctggaccggtccgggaaccgcgcccagcgaggtctggaccttgggggccagggcggcccaggcgaccaggaacaggccgatggccagcagcggcacgcccaactggcgccacagctcgatcaattgggtgcggggcgcgctgcccgacagcagcttggccagcggcaccacccagcccacccccgccaccgtcagggtgggagccgcccggttgagggcgtgggagaaggagaaggcgggtctggcgggcttgggcggggtgccggccgtctgggaaatgctgttcatgatcgggtcctcgcttgcagtcacgtcttgtctcgctcttgccctctttcaccgccgccgggaggggtcccggcggcgatgatgaacgtcagttgccgaccaccttgttgctctcgagcttttgggcgcccttgaggccgatggtgaacttcttcaggtagtcgttgggcttcttgccgtcatagctgatgccgtcgatgaactcggcggtgggggcgcggtagccgtcgctgtcccaggggaagtcctccttggcgaccttgccctcgtcgagcagcagcttggcggccttcaggtagacgtcgggcttgtagaccttcttggccatgtcggcgtaccaggcatcgggcttggcctcggcgatctggccccagcggcgcatctggctgagataccagacggcgtccgagtagaagggataggtggcgaagtagcggtagaacacgttgaaatcgggaacggcgcgcttgtcgcccttctcgtattcgaaggtgccggtcatggaattggcgatgaccttggcgtcggcgcccacgtattccgacttggccaggattttcacggcctcatcgcggttggcgttgttgttctcgtccagccacttgccggcgcggatcagcgccttgaccaccgccagatgggtgttgggatacttctcggcccaggcgttgttgacgccgaacaccttctcgggattgttcttccagatctcgtaatcggtgatcaccggcacgccgatgcccttgaacacggcggcctggttccacggctcgccgacgctgtagcccgagatggtgccggcctccagggtggcgggcatctggggcggcggcgtcaccgacagcagcgcgtcggcggcgatctggcccgagacgttgtcggggctgtaatagccgggattgatgccgcccgaggccagccagtagcgcagttcgtaattatgggtcgagaccgggaagaccatgcccatgttgaagctcttgccctgggccttcatggcgtcgaccaccttcttcagggcgtcggccttgatggggtgggcgatcttgccgtcgggccccttgggcaggtgcggcttcatcgcctcccagacctcattggagacggtgatgccgttgccgttgaggtccatggagaaggctgtgaccacgtgggcctgggtgccgtagccgatggtggcgccgatgggctgtccggccagcatgtgggcgccgtccagctcgccagagatgacgcggtccagcagtaccttccagttggcctggggctccagggtgacgaacaggccctcgtcctcgaagaatcccttttccttggcgatggccaggggcgccatgtcggtcagcttgatgaagccgagcttcagttcgtccttttccagcttcagcttggcggcttcggcgccatggggcagggcaagggccatcaggccggccgccgccagtcccagggcggcgcgtcgcgccaagcctgtgtttccgaagttggtcatcttgctcatgtcagccctcgccaagtctggagttcaaaacgcaaaaaaggcgctccgcggcgtcacgcagccccttggcggggagcgcaattccgtggaacgcctttgttccttttcgaccgggccggcatcgtcgccgggctggccgtctgtcatttcgtggggcggggcctcgccattgaggggaccgccttcgcaggacagtccaaagcaatgggcgtgccagaggtgccgaggggcggatttcggggggtgccgatattgcggcgcaccaggcgggcgggtgcgttgcttaaaatttaatcggacaatttctgtgagattaaaaaataggcagatcagcccagcagctcggcggcctcgatgatcttgttggccacgtcgatcaggcgctgcttctgatccatggccatgcgccgcatcagacgataggcttcgtcctcttccaccttgcggcgcttcatcaggatgcccttggctttctcgatctgcttgcgttcggccagggtggtccgcgccttgtccagttcaccgcgcagggcctggaactgggcgaagcgggcgatggccacgtcgatcaccggacggacccggtcgggcttcaggccgtcgaccacataggcggagacgccggcctccaccgcggccttgatggtctcgggcttgccgtcctgggcgaacatcaccaccgggcggccctgctcgaccccgacgcggcgcatgtcttccagcgtgtcgcggtcgggggaatcgatgtcgacgatgatgatttcggcggcaagctccgccactcgcgcaggcagtccggcgccgctgccgaacaccgccaccaccgtgaagccgtcggcctccagcgcgtcacggaccatttccgcccggtcccgctcatcatccaccaagatgacccgcaatccgctggtcctttccgattatggcaatggttttaaacaagcatgcatcatgccagttccttgggagtgcgtccccagggaagttgaagccatggccgggcattgcaatggcgccacgcggtgctacccttcaaggcatgggcagatgaggagcgcaagcgaagtgacccgatcgatcatggtggcggctcttctcgtggggctggcggcttctccggccctggccggcggcaagaaggaaggctcgggcagcggcagcggcggcgaatcccagggcgccatgtggtccagcctgccgggaccgcgcgaggtggtggtggcgccgccgcagatcagcgacagcctgggtgtggtgtcggtcaacgccaccatgtgggccgggtcgggctcggccaaatgccgggtgaatttcaccgtcgagaattattcctcggccaacgtggcgttgggctttgtcgcccgcacctttgggaccaaggacgaagtggtggacaattgggtggttaccgtcgccaccttgccgcccaatggccggaccggccggctgttttcctgcactctgggcgccgtcgagctgatgctgattccgacctcgggctacgactggcctcccgccaagtgcatcaagggcgccgaggaggccgagccctgtccgctgactctcaagatcaactcgaccgtgccgatcatccttaagaaggaagagaagaaggatgacgacaagggcaagaaagacgagaaaaagagcaagcattagccccggccggactgtcctccgcaatccaggccgctatattagcgcctggttgagctagacctttgtcagccttgtcgcggcgccgtcccggcaatacggtttgccccgcaaatgggggcgtgggcacatgctgtcgggtccggttgaagggtggatgaggaaggccgcagcctggttgctggcggccaccctgctgctggggaccatgccgccggttccggcggcgctgggggccggtgggccggattccttcgtcgccgccgatctgtgctcgtccgcccatcaggaggccgatcccgcccaggccggcggcgccacgcatgattgcgccagccattgctgtgtcgtgtcgggctccattctgccgcccgcgccattgtccttgcggccgcttggccgggtgctggccgaacggatcgtgccgacgcccccgtcggcgccgtccgagccgccccgctccgtccaccgcgcacgcgcccctccgttcctcgccgcctagcgtccggcccgccttgatgcgggccgctctcaagcgattcattcatcgaggaacatcatgacctgccacgcgattcatcgtggcggacgtcggcacggccgcgtccgtctgtttgccacgaccttcctgacctccgtccttgcctccggggtggcccccgtcctggccgaggacatccccgaggtggtgatcaccgcgccgcgcctcagcattccggccgacgccaggctggatgccgccggggataccgccaagctgctgtcgcgcacccccggcctcaacctgatctccaacggcggcgtctccagcctgcccgacatccacggcctgggcgacgaccggctgaagatcctggtggacggcatggagaccacctccgcctgctccaaccacatgaacccgccgctgtcctatatcgattcctcccgggtcgagaaggtcgaggtgtggagcggcatcaccccggtcagcgccggcggcgacaatatcggtggcgttatttccgtgaagtcggcgccgccggtcttcgccgggccgggcgagggctacgcggtgggaggacggctgtcggccttctataagagcgtcaacgacggcgtgggcgcctccgtcgccctgcacggcgccaacgggaccttcagcctgggctatgacgggtcctgggccatgggccgcgactactatgccggcggcgatcaccgggcggtgttgtccaccctgtacgaggcccgcaaccacgccctgaccttcggcgcccggcacgaggggcacctgctggtgctcgaagccggtcagcacgacattccctatcagggcttttccaaccagcgcatggacatgaccgggaaccggggcgttcacggcaatggccggtacgagggcgagttcgcctggggcaagctggaggcccggggctactggcagcaggttaaacatgccatggaccagatcggcggcgagaagaacggcaagatgcccatgcgcaccgacgccatcgacctcggctacgccgtcaagggcgacatcagggtctccgacggcaagaccatccgggtggggcaggagctccaccgcttcctgctcgacgattggtggccgccggtggcgggcagcatgtccatggcgccgaataccttcaaatccatcaatggcggcagccgcgacgtgatcagcgccttcgccgagtgggaggagaagtgggcgccgcaatggactaccctgctgggcgtgcgcagcgataccgttctgatggataccggcaacgtggccggctatgtcacgaccggcaccgaggccgccaatgcggcggccttcaacgccaagaaccacgccaagaccgacttcaacttcgacctcaccgccctggtgcgcttcgagcccaatgcgatcagcaccaacgagttcggctatgccaggaagtcccgctctcccaatctttacgagcgctattcctggtcgaccacatccatggacagctcgatgatcaactggttcggcgacgccaacggctatgtgggcgatcccggcctgcggcccgaggtggcgcatacggtcagtacctcgtttgccctgcatgattccggccgcaaggaatgggcggccaaggtgacgccctatttcacctatatcgccgactatatcggcgtcgattgggtcagtaactccaccacgcgaagctcggtctttccgctgctgaaattcgccaaccatgacgccatgatgtcgggcgtggatgtctcgggcagcaccttcctggcccgcgagaccggctatggcgatttcaaggtgtcgggcatgatcggctggctgcacggcgagatggtcaataccggcaaggccatgtatcacgtcatgcccatcaacggcaaagccgccctcgagcacggctggggcggctggaccaatgcggtcgaagcccagttggtgggaaccaaggccggggtcgatccgctccgccgcgagcccaagacgccgggctacgccctgctcaacctgcgcagcggctatgagtgggagaatttcctgctcaatctcggcatcgataacgtcttcgacaagcgttactaccacccgttgggcggcgtcgattactccgaatggaggcggcacagcctcaccggccaggtgggcgccctgccggcgccgggccggtcgttcaacgccggggtgacggtgaaattctgatcctgggctccgaggggggctccccctcgggcctcaggcatagggctgggcgttgaccatttcgacgcgccagcccgaagccgtggcgtcgaggcgggtcagtgacagcggcttgaccgcgacgcgcagcgcctgttccggcttgagatccagcgccaccgccagggcggcgcggaccgttcccgcatgcaccacggccaggatatcgcgccccgcctgggcggcggtgatctgctccacggcggcgcggacccgctccaccatggcggcgaaactttcgcccccgggcggggtggcggtggccgggtcggcccagaaggcggcgaggtccgggtccttggcggcttccagttccatccatgaccgcccctgccagcggccgaaatcctgctcggccagatcgggctcgaccatgggcggcggcagcagcaagccgccggcctccagcgcccccgccgtctggcggcagcggatcaggccgctttccaccaggaccggattgaccggcagggcgcgggccagggactggaagacctcgtcctccgaggtgtcgcacgccacgtccaggcggccggtgatgcggccgtgggggcaggggaccggagcgtggcgcagcagccaccagcgggtggaatgggaactcatggactaaggactcctgcggcggccagcaggacgccgatctctgtggcttgttgcacggcgcccagcacgtcgccggtatagccgcccagggcgcgccgtgcgatccacaccacggcgccgcccgccgccagggcggccagcagggcggccagggtgccgccgaggcccagccctgccaggcaggccagcaggcccagcgcggcggcggtggcggcgatggtggcgtcggggcagccggcgcccgctcccaatccgtcgcgtcgcgccggccccatcacctgcatggcggcggggatcagggcacgcgacagggcacaggccgccaccagggcggcgcattggctccagcccgggggaatggcggccagggcggcgacgcgcaggccgacggaaaagatcagggccagcaccccgaaggcgccgctgcgggaatcgcgcatcacctccaggcggcgctcgcggtcgccgcgtgcacccaggccgtcggccaggtcggccaatccatcctcgtgcagggcgccggtgaccagcaccagggccagcaccgccagcagggcggcggccaggggcggcagcacgccgcccgccgcccagacgacggcggcggctcccaggccgaggcccagcccgaccaggggaaaggcgcgcatggaccgcgccagatcgcccaggccggcatcgggcaggggcaggcgggtaagaaacaccgccgccagatgggcatcgcccagccaggatcgcggcagcggattctcgtcgatgacaggtgactcgctcatggcattgggttataggacgggctcggctgggccgcaacatgttgggagaatttccttgaattcgtctatttctagcgttgcccagatccgctccctgctggccgccctgcccggtcccgatgccgccgcctcggccgcctgggcggcgcgcgagccgcaactgaccaagccggccggctcgctgggtcgcctggaagaggtgtccgcctggctttccgcctggcagggccgtcatccgccggccatggagaatccggtggcccgggtctacgccggcaatcacggcgtggcggccctgggcgtctcggcctttcccgccgaggtcacggtgcagatggtggccaatttccgccggggcggcgccgccatcaaccaactgtgcaagaccttcggcatcgggctggacatcctggccttggatctcgaccgccccacggccgatttcacccggggaccggccatggacgaggccgagttcgccgccgccttccaggccggcatggactcggtgcccgatggcgccgatgtgctggtgatcggcgagatgggcatcggcaacaccactccggccgccgcggtctcggcggcgctgttcggcggcgaggccgccgactggaccgggcgcgggaccggcgtggagggtggcgccctggcccgcaagatcgaggtggtggggcaaggcgtggccttgcaccgggggctggcgcccctcgacatccttcgctgcctgggcggacgggaactggcggccatggcgggcgcggtgctggcggcgcgcctcggacgcgtgccggtgctgctggacggctatgtcaccacggcggcggtggccgccctggaactggaatgcaagggggcgctcgaccattgcctggtcggccatgtctcggtggagccggggcaccggcgcctgctggcggcgctgggcaaggacgcgctgttcgacctgggcatgcgcctgggcgagggctcgggcgccgcgctggcggtgggcgtgctgaaagccgccgccgcctgtcatgcgggcatgcacaccttcgcccaagccggagtcagtgacaaggacggggcttaggcccataatagcccccttgtttttccaagaggccgtcatgcaaagccagaaacccttcttcgatgatcttgcccgcgtggcgtccggcgcgctgggcgcgctgtccggcctgcgggccgagatggaggcgatgatgcgccagcagttcgagcgcttcaccgccggcctggatctggtcccgcgcgaggagttcgaggtggtgcgggccatggccatcaaggcccgcgaggacaacgaggctcagttggcccgcatcagcgagctggaagccaagctggagtccctggcggccgccccgtccaagaccaaggccgcgcccaagcccaaggactgatgtcctgggccggtggccggaggcattccgggttatccacataaattcataaatactccgtgaataaagccttgcgcccgctgatggcgtttggttaggctaccccttgtgcgaatttcgcaggcgcaaacacaatcttttgattcgcgccggtggaatcgacggtagccatgccaagggagggcgcgggcatgaccttgaccgccacgtatcaggaagagccccagatcaatccagtcgacctcgtcgagcaagtcgtcgccgccaatgactgggcgttcgaccggcgcaacgacgaggaactggctgccgaggctcccggccagtggtgcaattacagcctttatttcgcctggcgcgaagatatgggcgccatgcacttcacctgcgccttcgacatgaagattccgcccgcccggcggcccatgatccatgaattgctggccaccttgaacgagaagctgtggattggccatttcggcctgtgggaggacgagggcgtgcccatgttccgccacacctcgctgctgcgcggcggggccggcttcgcgccggaacaggtggaggatctggtggacatcgccgtcaccgagtgcgagcgcttctaccccgccttccagttcgtcatctggggcggcaagaccgccgccgaggccattgccgcctcgctgctggagaccgtgggcgaagcttgacttcgcgccacgctccgtgccatgccggtcgtcctgatggaccggggcacgggaggcttttttcatgaccaagattctgctggtgggctgcggcaagatgggctcggccatgctggccggctggctcgagcgcggtgtcgctcccggcgacgtggtggtggtcgatccgtcctctcctgacctgggggcggtgggggtggtcacctccgacgccgccatcccctcggctttcgttcccgatgtggtgatcttcgcggtcaagccgcaggtgatggccgaggtggtgccgccctatgcccggttcgaccgctcggtcttcctgtccatcgccgccggcaagaccatcgccttcttccggaaccatctgggagccaaggcggtcatcgtgcgggccatgcccaataccccggcggcggtgcggcgcggcatcaccgtctgctgcgccggggaggccgtgcccgctgtcgcccgtgagctttgccagtcgctgctggaagcggtgggcgaggtgggctgggtcgatgacgagggcctgatggacgtggtcaccgccgtctccggctccggccccgcctacatcttcctcctggccgaggccatggaggccgccggtctggcccaggggctgcccccggccctggccgagcgtctggcccgtgccaccgtggccggggccggcgaattgctgcggctgtccgccgaatccgccgagcaactgcgcaagaacgtcacctcgccgggcggcaccacggcggcggccctgtcggtgctgatggctgaaagccacggcattcccagcctgatgaccgaagcggtggctgctgccactcgccgaggacgggaacttgcgggctaggcgcttcgtcagaggtggtacctatttcgatattagatattgagttgcgtatgactccgtttgactcgaagccgcccccgcgtctatcttgctgcaccgcaacataagacccccgggttggaggaataacatggccgccaagcagactgagcagttctttgatttcgacgtcgccaagtatctgggcgacttcaaggttcccggcgtggatgtcgagaccatcgtcgccaaccagcgcaagaacatcgaagcgctgacccaggcgaacaagctggctttcgagggcctgcagaacgtggtcaagcgtcaggtcgagatcctgcgccagaccatggacgaggttgcccaggtctccaaggatttcgccgagcccggctcgccccaggacaaggccgccaagcaggccgagttcgccaaggatgccttcgagcgcgccctggccaacgcccgtgagctggccgagatgatcgccaaggccaattccgaggctttcgacctgctgaacaagcgcttcacccagagcctggacgaggcccgcgaggtcttcaccaaggccggcaagaagtaagccttccgttcattcggaacgctgtcggcggccgctcctgaaaaggggcggccgttttgattccggcctgaattgggcgctctaccgtccctcgatcagggccagaagcggcgcccattcggcggcgtaggacttggaacggcggtcattggcctcgatcaccgtcgagccggcggcggccaccgcggtatagacctggctgtcgcgcaggcgcgccaccacgggaaagcccagcccgccgaaaaagccgtccagatggtcgctggccttggtgccggggcgcaggcggttgcccactacggccaccacgcgcttgttcttgcgcaccgccttgaccttggcgagacgctccaggaagtgggcggtggcatcctcgtcgaaggcgccgggcagcacgggcaccaccaccacttccgaaatatcgatgaggtcctccacatccttgtggtgcatggcggcgggggcgtcgatgaccagccggtccaggcccttgggcggcgagcccacgtccttggaccagtccaggccggtgatggcggggagggtggcggggcggcggcgcagccagttgaggctggagcgctggcggtcgcaatcgccgatggcggtgaccagcccctgggcggcgaaagcggcggcgatatgggtggccagcgtcgtcttgccgcaaccgcccttgatatttcccaccagtaccgtccgcatgccgaaagccccccccttaactcgggcaaagcctatcacaagggcaggcgaacgcgcgcgcgcaatccgcccagcggcgaatcctctaaaagcaggtcgccgccatgggtgcgcacgatgtcgcgggcgatggtcaggcccaggccgacgccgccggtggccagattgcgcgaggtctccaggcgggtgaagggcttgaacacttcctcgcgctggtcgggagggatgccggggccgtcgtcatcgatcagcacctcggccgcctcgccgcgccgcccgacccggacccagacgtggccaccgtaacgcgaggcgttaccgatcaggttacccagggcgcgggccagggaatcgggacgcagcggcatgacgatctcgccctcgtggtgcaggtcgatgaccatgccctggcggcgaaagcgggtgaccacctcgtcaaccagggccggcaggtccacctgctcgggctgctcgctgccttcgccccgggcaaaggccagatagccctcgaccatgcgctccatctcggctacgtcctcgtccagttcggcgcggccgtccatgtcgcccatgatggccaattgcagcttcatgcgggtgagcggggtgcgcaggtcgtgggagaccccggccagcatctcggtgcgctgctgcatctggcgctggacccggtggcgcatcaggttgaaggcctgggcggcctgccggacctcctgcgccccttcgggcttgaagtcggccacatcctggcccttgccgaagcggtcggcggccaccgccagcttgcgcacgctgcgcacctgattacgcatgaacaaggtggcgatgccgaacagcagcatggcggtgcccagcatccacaggatgaagacataggtggtggagctgaacagccgcttcttgggggcgaagacctccagcatcccgtccgagagctggacacggatgaccacctcgcgttccagggattcggcgtcgatgcgataggggcgctggacccgctcgtccagggcctcggtcagggcgcgttccagcaggcccgagggggcgccgcgtggctggttgggcaggatggcgccgggcaggaagcgggtgtccagttccatcttgttggcggcgatggacaggatcaggctccgctcctgttccccgggaaaggcgcggagcgattcgatgatggtgccgatgtcgccggccaaccccttggccaagcgcttggccaccgattcccagtgactgccgtaaaatacgtaggcggacaccaactgcagcaacaccagtggcatgatgatgatcagcagggatcgccccagcagaccctggggggccagacgcttcagccaccgcccgagatgagacattccagaaggcctctcaaacgccggaatttccggtcagtcgggtcgcagcatatagcccatgccgcgcactgtctgaagatagcgcggcattttcgggtcgtcctcgatcttcttgcgcagccgggtcacctggacgtcgactgtgcggggattggccgagtttcccgttcgcgccgccagatcgtcacgcgacaccccctggccggagacctcggccaggatggacagcaggtcacgctcggcctgggtcagatgaacgggctggtcgtcctggcgcagctcggcgcgtcccatgtcccagacgaaggcacccagtcgaagctcgcgggtgggctcgggctcgtcacgggggctgcggcgcaggatggaggcgacccgcagcagcagttcgcggggttcgaacggcttggacagataatcgtcggccccggattccagccccttgatgcggtcatccacctcgccgcgcgccgtcagcagcaggatgggcaggccgttgccctcggcccggagcgagcgggtgagcgccatgccatcctcccccggcatcatgacgtcgagaaccatcatgtcgaaagccaggccggccatgcattgccgtgcctcggcggcatcggcggcggtggccaccagatagccgttgtcggacaggtatttgcgcagcaattcgcgcagccgccggtcatcgtccactaccaggatatgggcgtcgtccatggggtcaggctccccggcgcagtccggcggcgcgggcggggaagcggccgcggtcggcctcgtccaccaggcccagcatcaccttgcggaagccctccaccgcctcggcgccggcttcgcggtaggcgcgggcgatacgagcccgctggcgctctgtcagcagccgctccagttctatccctttctcggtcagttccagcaggcgctggcggcggtcgcgtacgccggggcgctggacgatgaacttctcctccaccaactgccccagtactctcgagaggctctgcttggtaatgcgcaggatttcaagcaggtcgctaaccgtgatgccggggtggcggccgacgaaatagatgacgcggtgatgggcgcggccgaagccgtactcgcccagaatggcgtcgggctcggccgtgaaatcgcgataggcgaagaacagcagctcgatcccctggcgcagttcctcctcgcgcaggaacagcgggtttatgccggtcttgatgtcgctcatggcgtggttacgtcagtcatgttgacatatatggcctataaatgttacgtcatgcaagagagattggtaattttccaacctcccgccccgcccttaccttctaattggaacggaacgaccatgtcagtcctcccctttgacgaccgcgacggctttctctggtttgacggcaagctggttccctggcgcgatgccaagatccatgtgctgacccatggcctgcattacgggtcctgcgtgttcgagggcgagcgggtgtatggcggcaaggtgttcaagctgcgcgagcattcccagcgtctgatcgattccgggcgcattctcggcttcgaggtgccgtggaccgtcgaggagatagacgaggccaccatggccaccgtcaaggccaacaatatcgtcgacggctatgtccgcccggtggcttggcgcggctccgagatgatgggtgtcgctgcccagaccaccaagatccgcttcgcggtggccacctggtcctggcccagctactggagcccggaagcccgcatgaagggcatccgcctcaatatctccacctggaagcgccctcaccccgagaccgctcccaccgcctcgaaggcggcgggcctgtacatgatctgcaccatgagcaagcacaaggccgaaggggatggatatgaggattcccttatgctcgactggcgggggcaagtcgccgaggccacgggggccaatatcttcttcgtgttcggcaatgagctgcatacgccgacccccgattgcttcctgaacggcatcacccgtcagacggtgatcgcccttgccaaaaagcgcggcataaccgtggtggagcgggcaattttcccggaagagatgaccaaggccagcgagtgtttcctcaccggcaccgccgccgaggtgacgccggtgcgtgaaatcggcccctacaccttcactcccggcgatattacccgtcaattgatcacggattatgacgcattggtgcgttcctaataatattcggccgcagcgcccggccctttcttgtggaacatcaaatcccggtattttcttttccgggctttcgtaataggctccgcaagggaattggatgggcgctgcggtcgggtcgggacgatcgcgttggaacggatgggagtctccgtgtcgcacgcgtggcagaatttgcggctgtccagtcgcttcatgcttattgtcggtgccggcgttattattctgatcgccggagtcgtcctcacaatcgcccgattcgaacgcaccgagatggagcgccagttaagacagatctcggccaacgagatgacgtcgctgcatgcgctgatcctcaacgtgatggccaagcggcccgaggattccgacaatatcggcatcacggtcttcaacaactggttcgattcccgcaacatccactatcccggcaaggtgtggagcgcctgggggccgaaggtggccgcccatatgaaagaggtcgagcccgagagggcgccgaaactgcccaaggacgacatcgatcgcgaggccttcgagaccaaggtcgcggtcgggcggttcgacggcggtttctaccgctattcgctgcccatcgtgttgggcgtcaccgacggcgccaaggaagaggtgtgccatgcctgtcacggcggcatgggcatggtcgatggcgacgtcatcgccgtgctgtcctccaccctgtccaccgcggaatccgaggcccgcctcaatcaggttctgacctggctggtggtgggcggcgtgatcgccaccatcctggcggtgttcggcgtccgaaccattctcaagcgcattatcgccgatcccatcgaggacatgaccgagcgcatggagcaactggcgcggggcgatacctccatcggcgttcccgcgctggaccgcaaggacgaggtgggcgacatcgctcgggccgtccaggtcttcaaggacaataccatcgccaagcagcagatggaggtggaggcccaggccgccgccgccgcccgcgatcggcgcatgcaccatctggaagacctgattgccgccttcgacaaggcggtgacggcggtgctggattccgtgtccgcctcggcgcagcagatgatccagacggcgcgcagcatggtcgattctgccgatcaggcactggaaaaggccaattccgcggcacggcaggccagcgacgccaaccagaacgtcagcaccgtggcctccgccgccgaggaactgagttcttccatcagtgaaatcgcccagcaggtcggcatgtccaaccaggtggcggtctcggcgaccaaggaggccgattcggtcaatacccgggtgcaggggctggccggcgccgccgacaagatcggcgccatcgtcgagatgatcaccggcatcgccgagcagaccaatctgctggcgctgaacgccaccgtcgaggcggcccgggccggcgaggcgggcaagggcttcaacgtggtggcgtccgaggtcaagaacctcgcccgccagaccgtgggcgccaccgaggatatcgcctctcaggtcaataccatccagcaggaaaccgacaagacggttcgcgccattcgcggcatcaacaccaccatctcgtctatggacggcattaccacggccatcgcctcggccatcgaggagcagggtgccgccacccaggagatcgcccgcaacatcgaccacgccgcctcgggcaccaagttcgtgtacgagaacatcaacgcggtgacccagaccatccacgagaccgaccagtcggccaaggatgtgctgggagccgtggagacgctgcagcgtcaggcgcagaccctgcgggccgaggtggatcgattccttcagggcatccgcgaggcatgatcggcgtgcagggccggtaagcgccgggcgaaaatgggggggcggactttccgccttccatttcagaaggattacaggtaactctaaccccctcgatcagggggtattcatgagcctgcccaagaccgtgcttgattgtccgcattgccagcagagcagtgaccatcgtgtccattcctacggagacggcaccgccatcgtatggtgcggcgcctgtcataacccgcgggaattgctgatggcgcaattgcgccgtctggccgggcgcggtaccctcgccgccgtcgtcgccgccgaatagcggctggcgcgcgggcctacagcacgggcgacggatcctcgtcgaggatgcccggccctctctcttccacaacctcgatgcaggcctgtaccacggcggggtcatagcggctgcccgaatgctcgcgcagttcggcgacggcgacgtccagtcccagggccgggcggtaggggcgatgggacgagatggcctccagcacgtcggccacggcgatgatccttgattccagaatgatctcgtcgcccttcagtcccagagggtagccgctgccgtccagcctttcgtgatgctggcggatcatgtcggccaccggccaggggaattcgatgtccttcatgatctcccagcccatctggggatgcatgcggatgaccttgtgcacctcggcggacagcttgcccgggcggctgagaaactcggcggggatgtgaatcttgccgatgtcgtgcagcaatccgccggtgcgcaggccctccacgaccgcctcggacagtcccatccgctggccgatggcagtggacaactgcgccacccgccgctgatggccggtggtgtagggatcgcgcatctccagggtcagcgacagcgaacggacggtctgaagcaacacgcgcttcaggcgttcggcggtgacgcggcgctcctcctccacggctttgcgttcgatggcgtagaggatggtacggcggatcaggttgccatcgccctggcccttgaccagatagtcctggcagccgtgctgcagggccagcagacccatggattcatcgtccaggccggtgcagatgacgatgggcagggtgggggccgcgacgcggaaccgctccaccgtctcgatgccatgggcatcgggcagcgacaggtcgagaaggacggcatcggggggctctgcggccaccatgcccatggcttgtcccaggcaatcggcgcggcggcaatggatgccgccgacctcgctcagcagcagttcgatcaggcgggcatccgccggattgtcctcgaccaccagaaggtctacggctctcgatcgcatgtcggtcatgttctgatcccgcttcaaatgcatcgagggaggggcgccaaggagggtgggggccacgtgcaccaccccaacgttgtgacacagtgtgtcggggatgttaagggggctgaaggcgcggcaggcttgctgcttatgcacttggtcatggtctggctgaaatggcgggggagaccgagggtgaggctgctgcgccgcaaaacatggaaataacaggtataaatcaaaggtagaatactcagggggctcggcaaaacgctttataatttgttaatctagtcctaaggtaatagttcttccgtggcgaagtggcctctccctgggggctgtcggccctcacggaatcgaaagacggaggttgccatgggcggactgaaactgggcatcggaggaaaaatctgggcgctggtggcgcttctcgtggcgggtcttggactgctggcggtccagagtctgtcatcgacccatgaaaccctgatcgaggatcgccgccaagctctgaagcaggttctcgattcctcggccagcgtggtggagagcttccgcgcccgtgccgccaagggcgagttcagcgaggaacagggcaagcgtctggccatggagacattgcgcgcctggcgctatggcaacaacgactacgtcttcatcaactcgtacgacatgcgtccgctgatgcacccgctccgtcccgagatggagggccaggaccagtcggaaatgaaggaccccaacggggtctatgtcacccgcgccatgatcgaagtggcgcgaagcccggccggagccggcttcaccagctatcactgggccagggtcaaggataagcccccggtacccaagctggtctacgtcatcaattacaagccttggaactgggtgctgggaaccggcgtctatatcgacgatatcgacgaggcctatgcggccaaggcgctcgatctgggcaccaaggccgccctcttgggggtattggccgccgttatcgcggtgctgatcgcccgctccatcaccgggccgctggggcagctggtgtcgcgcatgcgggctctggccgagggcgatatcgagcgtcaggtcgaaggcaccgggcgcaaggatgagatcggcgccctggcccgcgccatggaggtgttccgcggcaacgcccgggaaaatcgccgcctgctcgatgagcaggagcagttgaagctggcggcggcccaggaacggaaccgaacgttgagggacatggccgaagggctggagcggcgggtcaaatcggcggtggacgccatcaacaacgtggggcagcgcctcaatggcgcctccagcgccatgacccagacggccgaccagacctcagagcagaccggcgccgtggtcgccgccacccagcagacctcgaccaacgtgcagacggtggcttcggcggccgaggaattgagcgcgtccggcaacgagatcagccgtcaggtgtctctgaccgccgacatcgcccgcgccgccgccgaggaggcgtcccagaccaacggcatggttgccgccctggccgccgccgccgggcggatcggcgaggtggtgcagttgatcgacgccattgccggtcagaccaacctgctggcgctcaacgccaccatcgaggcggcccgcgccggcgaggccggcaagggcttcgccgtggtggcgggcgaggtcaagaccctggccaaccagaccgccaaggcgacccaggagatcaccacccagatcgccgcggtccagaccgagaccacccgggccgtggcggccatccgccatatcggcgagaccatcaccagggtggacgaggcgacctcgtccatcgccagcgcggtggaggagcagaatgcggccattcacgagatcacccgcagcgtccaggaagcggcgcgcggcacccgcgaggtgaccgagcatatcagccgggtgtccgatggcgcccggacgtccaagtccgccgccgaggaggtggccggctcggcccgcgagatggtgacccagaacggcaccctgactcgcgagatcgacggcttcctgcgcgagatccgcacccaggcatcctgagtccgggcatgaaaaagccccccggccctgcggccggggggctttgtcttgggcggcctacttcaggctttcgcagaagcgcttgatgcgctcggcggccttggtcagcgcagcgtccgaggtggcgtaggagatgcggaaatagggctccaggccgaaggcggcaccctggaccaccgccacgccctcggcttcgagcagcgcgccgacgaagtcggtgtcgttggcgatgaccttgccgtcgggggtcttcttgccgatcacgccggcacaggacggatagacgtagaaggcgccttccggggtgcggcaggtgatgccggggcactggttcagcaggccgacgatcaggtcgcggcggcgcttgaacaccgcggcgttcttcgggatgaagtcctgggtgccgttcagggcctccaccgaggcggcctggctgatggacgaggtgtgggtcaccgactgggactggatcatgttgatggccttgatgatggcggccgggccggcggcatagccgacgcgccagccggtcatggcataggccttcgacacgccgttcatggtcagcgtgcggtcatacagcttgggctccacctgggcgggggtgcagaacttgaagtcgtcatagaccaagtgctcgtacatgtcgtcggacatgatccatacatgcggatgccggagcagcacgtcggtcagcgccttcatctcgtcccaggaataggcggcgccggtcgggttggacggcgagttcagcaccagccacttagtcctcggcgtgatggccttttccaggtcggcgggctgcagcttgaagccggcggtctcgggacaggggacgaagaccggcttgccgccgaacatcagggcgatgtcgggatagctcacccaatagggggcgggcacgatcacctcgtcgccgggattgatggtggccatgaaggcgttgaagatcacgcccttgccgccgacgcccacggtcacctgatcggcggtgtagtccaggccgttctcgcgcttgaacttggcggcgatggcctggcgcaggtccacggtgccggccggcgggccgtacttggtcagacccttgtcgatggcggccttggcggcggccttgatgttgtccggcgtgtcgaaatcgggctcgcccgcgcccaggccgatgacgtcgcggccggcggccttcaactcggcggccttctgggtcaccgcaatggtcggggacggcttgatggcggaaagcctgtcggcgatgaacggcatgggtcgggtcctcgaaaaagatgagagaattcgcgggtggcgaaggtacgcgtgcgggcgtgcgagtgcaaggggacaaagttgtatgcaacgagtaattgatattttgatatggaccaatgagttatgaggtgtgatacttaggccgccccaactttggggtggcacattgtcggaagagttaagatatcaaatgctcggctatggcagctttggagtccttgaagtcgtgttcgcgcttgctgcgattgcgattcttgtatgggctgtttctctcgcggctcgctcttctgagagaggtgcgcgagaaagcgcggagtctgagccagttgcgcatcgtgatgaagataaaagcagggtggcgcactatttaccaaacttgtttgccgctatcgtggcgatgtattcaagtgcaaaattagcaagtgaattttccaaggagtcgattgttgctgccgccatcgtggctgcgatttcgtcatgcatttgggctattcttgttttttgtcagcactacgttgatggtgttgataaaaaagaaacgatggccgatcatggtaggaagtataaggcaattaagggcataagcggtgagctcgcagagtttaagagctcaattggtgatttcggcaagtctgtttctagtcttgaagatgctgttggaaaaagtacttcagacgtggcgtccgagttcagcacggcgaagtgtgcggttgaggtggcagctaaaaagcttaacagtgcggctgataagttatctaaattacttgatgccgggcgtggtgctagcgtctaagtaggtatttaaggttgtaatgtattaatggtgtttccatgccgttgcaaatttctgggtcatttgtcaggcagatcattgcaacaatagagatgttgccctcgacaaggggccaatcaaccaagggaagcggggttcaaattcttgtctcgccgcttatcttaacggtggcgtcggttcttcttctgcttgcgccagataaaaataatgagggcaaggcaggcacggaggcggcggaggcttccgtgaatgcgagcaagcccgtgacaagccctcctgatgtggctggttctggaggaaaatctgcaacgagcggcgttcgccaaccagttgcgtacgcgatcttcgatctcgaaggtcgggatgatccggtgcgatattgtctgcccggcccgggggggcgatgcggcgcgccttcgagggaactgctggatatggacggcataaaacggatcgtcgacacgaaaggtggagattgttcatcgaaggtggaggtgcgggggcgggccaccaagggagccggcgatagccctctctttgacaatgagcaactcgccagggaccgggcggtacgtgtctgtgagttgttggaaaaggaggggcttgggtgccgtgtcgccaacgacgtcgtggtcggcggacgcgatccggaattccggcgggccgagatttccgtcgctgccgattgctccgcgaatacaaaatagcccctttgccaatcaggggggctctgcgcgttcatcgattgccattccgctggggaagtggaatcatgcggcccttaccttcagcctgtgggaagtgctgtttcatgaggatcgccgcttgggttgccgcgctgctcgctctctcgttgcctctggccgccggtgtcggggcggcgccgaagacggcggccaagccggccgccgccgtcgccgaggcgcggcacgccagtctggcagccttggccgccggcggtgacatggatgcccagtatcagttggccgtggcctatcgtgacggaacccacgggctcaagccagacccccacacggcactggtgtggttcaccctggccggggccgaggggcatgtgggcgccgccatcgaggcggccaaggcctatcaggccggcaagggcgcggcgcgtgacctcaattccgcaggcaattggtggtacaaggcggggaccctgggccatgcggcggcgcggacccgatgggtcgagctgttcgtcgagggcgaggtgcacgccatcggtagccgcgacggggtgtcctggctggccgaggccgcccaggccggtgatctgcgggccatgatgggcttggccgacgtgctggagcgcggccagggcgtgccgccggatctggaccaggccgaggcgctttaccgtcaggcggcgctgctgaacggcgatatcgaggcgcggttccgcctcgggcgcctgctgctgtcgcgcccggccatgtggcgcaatcccgccgaggaggaatggaacgcccaggccgccgagcgcaagagccatcccttcggcgcggtgtggtacgcggccaagccggccaatgccgacgagatcaaatcggtgcagctgcgtcccggcatcaacgagggcgagcgctggctccggtccgccgcccgccggggacatgtggaggcgcagtatctgctgggctcggccaaggtggcggggcttgaactgcccatggacatggtcgagggcgtggcctggctggaagccgccgccgtacaggggcacgccgaggcgctgttcgagctgggcaatctggcagccaagggccagggcttctatgccaaggacccggtacgggcctgggtcatgtacgagcttgccgccggccagggcgaggagaatgccaaggccgcccgcgatgccatcgccaagggcatgaatccgcgccagtcgggccgcgcccgccagctggtccaggaattacgggagttggccgggctctgacccgcagtcgtccaacagggcttttcccgcatcgccgccgtcgccttccaggcgttcggcgatgatccgggccatgccttctcccagacgggcgaggcgggccagtccctcggggccgggggtcggattgtcctcgatcatccggcagagccgctcgccgagttcgctgaccaggggatagccgaaggtggcggcctgccccttcatgtcgtggctgatggtgaacaggcgggggatcagccgggccagatcggcctggggcgtctgggcctcgtccaggcaggcgcgcagtcgggccgcatcggcggcggcccattccaggtagcgcccggagagcccggccagagcggcctcggcccgggccagggcctcgggggacagttcgggaaggtcgccgtctccggccatgggggtctattccgccgcctgttccgtcgactcggtgcgcctgcgatcctgttcgatcaggtcggtggcgcgggcgatgatttcaacggcggaaatgggcttggcgatgatttcgtcgatgccggtctccaccgccgattccagcacggcatgatgcagggtggggctgatggccaggaccggcacgtcggcgcgcccgatctcgcctcgccgcagccgatggaggaacagcacgccctcggtcgggtcgtcggaccagtccatgatcaccagatggggggcgtgttcggccatcagcggcccagcctgctgtggggtccgggcttcgatcacctcatgggcgggcacggcccccatgagggtgccgatcagccgccgcatatgggcgttcggttcgatgatcaggacgcagacccgccgccccatgttcagtccccctgctgctccggctctttggccggatgtggacgcctttgcggcttatccggtgaacaccgtaacatcgttcgagtgtccgcgaaaatcgcgtctctagtattaggtagatacccaacaggatgcggccgaaaggatggggcttgcctcggccgcgcagccgggtgaccatggggcatgatgaggaagtttctctcgctgggtgtcgccgcccttgccgccctcctgggtgggtgcggcgatggcccgtccaccgtgcccggcggctatcgcagcgccgccacctggagcacctttttcgccgccaccgcgtcggggccgttgctgttggaagtgcacggcaatcctttcggcggcggcaaggcggaactgcgggacgccgtggccagggccatgtcggcggccattcccgcccggcccttcaccatgaccctggacgtccaggcgtcggcaagtcccaaggtgcgggtggtggtggtgctaggggcgccgccgtcgctggatgccgccgagctgtgcgccggcaaggtggcgaccgccgccttgcggtccgagggcgggcgggtggaggtgctggccgccttctgcgatggcggtgctctgctagcgtcggtgcgggggtgggtcggccgggtcgaagccgccgacgacgcccgtttcgtccggctgctggggcaggtcatgcgggaactggccggcgaccccccgccctgaaacctgatcgtgacatttcctgaagaatgagttaacgtggtcccctaatgttcagccagaaaggcagggccatggacgcatcatccgtcggtgccgggaactcggcgctttatcttcagcgtgctcaggctgggcttcaggccccgctgacggctgtcaagcaggaagaaaacgctgccatggccatggcgcaagtgctcacccagggcgggcagtcggcgcagcaggccgctgccgtggccgattccgccgtgaaaagcggggcggtcggtcaggttttagacatctcggtctaggcagggcttaagtccggcttgcgtgactggccgcagcgtcgatggcgcgggccagggagatgtccttttgcgtcacgccacccacatcatgggtggacagggtgatgtcgacccgattccacacattgaaccactcgggatgatgattcatccgctcggccgccatggcgatccgggtcatgaaggcgaaggcctcgctgaaatcggcgaagcgcagcgaccgcgaaatggcgtcgcgcccctcgacctcggtccagcccgccagccccgccaaggcgctggtccgctcgcttccgctcaatcttgcgatcatcttgccatctccttgccgggtgctatcgaaagagtggggacccctggtgccggccgcaaggacagggtagattctcaccatgagtaaagtcatgccccaccacagcacgccccccaccctggccgacctggagaccatcgcccaggcggcgttcgccgatatccccgaggaactgcgccgctttgccgccgacgtggtgatccgtgtcgacgacttccccgacgaggaggtggagcgcgagatggatctggaaagcccctttgatctgctggggctctatcgcggctcggccatggacattcacgccttcggcggcgtccccggcgacgtggacatgatctttctctatcgccgtccgctgctcgactactggtgcgagaccggcgaggatatttccaccctggtcaagcatgtgctgatccatgagatcgggcaccatttcggactgtccgacgacgacatgcagcgtatcgaggatgaagcgtgagcaaacgcaagaaagccgcccaccccgagtcgttgccggcttccgccctgtaccgggtctgtgatccctccctgcttgatttcaccactaccgccgagctgcaggacgatggtgacggcccaggccccgccctggggcaggagcgtgccgtcgaggccattcgcttcgccatcggcatgcgccaccgtgggttcaaccttttcgcacttggcgaggaggggacgggacggcgcaacctgatcctcgaccatctgggtgaggccgctgccgcccggccggcgtccgacgactgggtctatgtggagaatttcgccgaggccgccaagccccgggcgctgcgcctgcccgccggtcgggcccgcgtcctggagcgcgacatggcccatctggtggaggaactgggccatgctctgcccgccgccttcgaggccgaggactaccgggtccggcgccagatgatcgaggccgaggccaagcagcagcgcgagacggcctttaccgccatccaggaagatgccgaagcgcacggtatcgccctggtgcgcactcccacgggcctggggctggcgccgtccaagggggacgaggtcctgcctcccgacgagttcaagcaactgccggaggaaacccaagctcgccttcgggccgagatggagcggctgcagcagcggctggaatccaccatcaagctggtgccgcgctgggaccgcgacatgcgcggccgcctgcgcgagctggagcgtgaagtggtgggccatgccatcgcccacctgatggatgacctcaagggcgactgggccgaactgccggaggtcctggcctatctcgacgaggtggcccgcgacgtggcgctcagcgcccaggacttcctgcccgagtccgaagagcccgagcggcgagccgagggacggccgcacggacacgacggacgctttcgccgctaccgggtcaatgtgctggtctgccgcgagggcgacaagggcgcgccggtggtgatggagacctatcccacccagcccaatctcatcggccgggtggaatatatcgcccaatacggcaccctgatcaccgatttcaacctgatcaaggccggcagcctgcaccgggccaatggcggctatctggtgatggatgcgctgaagctgctgatgcatcccttcgcctgggaggatctgaagcgggcgttgcgcgaccgggaaatccgcatcgaatcgcccggccaagccatggggctgatgagcaccctgtcgctggagccccagcccattccgctggacctcaaggtggtgctggtcggcgaccccatgctttactacctgctcagtcacaacgatccggaattcggcgagctgttcaaggtctcggccgatttcgactggcgcatggagcgcagcgagaccaatacctccctgctggcccgctcggtgggggcactggcccgcaaggaggggctgaggcctctggaccggggggcggtggcgcgcatcgtcgagcaggcgtcccgcgacgtgggcgattccaccaggctgtccacccatatggccagcctggccgatctggtgcgcgaggccgattactgggcgggcgaggccggcgccgatctggtggtggccgatcacgtggaaagggccatctcggcctccacccgccggctggaccgggtgcgcgacagcgttcagcaggagatgctggccggaactgtccacatcgccaccgagggcgaggcggtgggccagatcaacgggctggcggtgctggaactgggccgcttttcctttggccgccccacccgggtgacggcgcgggtgcgctttggcaagggcgatgtggtcgatatcgagcgcgaagtccagttgggtggccccattcacggcaagggggtgatgatcctgtcctccttcctggcgtcgcgctatgccgccgagctgcccctggccctgtcggccactctggtgttcgagcaatcctacggcggcatcgagggcgattccgcctcgtccaccgagctttacgccctgctgtccgccctggccgaggcgcccatccgccagagtttggcggtgaccggctccatcgaccagttcggacgcatccaggccatcggcggcgtcaacgagaagatcgagggctttttcgacctgtgccgcgcccgggggctggatggcagccacggcgtgctgatccccgccgacaacgtaccgcatctgatgctgcgcaaggatgtggtcgaggcggcggcggccggtctgtttgccgtctatccggtggagaatgtggaccagggcatggcgctgctgaccgggcatccggctggcgagcgcgacggcgacggcaagttcccgcccggttccatcaaccggcgggtggcggcccgcctgggagccttcatgcgtcgggccgaggaattgtcggtgccgcgccccctcaacggcatgggccggaacggagcgtaaggcgatggtcggccgcctgcttctgctcggtctgctgctgctgatctcggccggcgccatggccagcgagttgcgggtgctgacccgatcctcctatctgtcgccggaattgctgcgcaagttcgagcgcgagagcggcatcaccgtcaatctgaccgtgatggccgatcacgcccaggtgatggcggcgctgaccggggggcggtcgggctacgacatcgccttttcccccgactaccatgtgggcgagctgattcgcggcggcctgatcgaacgggtgctggccgaccgcctcaacggcttttggaatgtggaggacccctggcgctcccggtccttcgatccgcgcaacgagtacaccattccccatcaatgggggaccgccgccttcgcggtggatacctcgatccatcgcggcgacatcgattcgctgcgcctgctgttcgagccgccgcccgaggtcgagggacggatcgccctgctggatgaggaggagatgctccagatggcgctggtctacctgggcgaggcgcgctgcaccgccgacgacggcaagctggagaaggccgcgcggattctggagcccatggtggcccgcaaccgtctgatacccgccgagcgggtgatggccgccctggccgatcccgccatggtcctggtggtgacctggaacggcgatgccatgcgggccagggaaaagcgccccagtctggcctatgcctatccgcgcgagggcaatctggtgtggaccgacgtggtggtggtgccgcgcaatccgcccaaccgggccaatgccatgaagttcctgaccttcatgctgcagccggagaacgccgccctggattccagcttcaacggctatgccagcatgatccggggcagcgaacggtttttggcgccctcggtgctgaccgccccggaactggtggcgccctggcccgccaaggtggggttccttccctcctgcggcgatgtcacccagcgccggcacgagaaaatctggggcgaagtgaaggcgcgcgcgggaaaaccctccgccaatccctgatcgcccgtcagctctggggatgaagcggggttccctgggggaccttgatgcgcaggccgggggtggggatctcggcgatgaagcgcccctgctgcagcttggcgcgccgctgcagcagcctggcatgggtgaccagcagggccgccgagttcatggcgaacagcacgatactggcccgcatggctccatcccccaggggcgccatcaggggaatggcgaacaggcacggcagcagggcatagaggaaggtgtcgcgccagcggcgcatgtagaccaccgccgaagccagggccgccaccggcgagaccagcaccatgtccaccttggcgcgcagcaccgcgtgggccgccacggcggcataggcgggcggcagcccctcgaagctggcgatcagcgccaggccgtcgctgctgggcgtgaaggtggcgcgcagggcgtccatcggccactgagcgcgcggaatggccgggcggatttccttgtacacagcacgagagaactcggaatcgggacgtagcaattcgctgaccatgagtcctggggcgcccctgctaatggatgacacggcactgtgccacgaccgggccggcggagccaggggcttggggtcagcgcccggtcgcggtcacggcaaagatgcggcgcggtgggaaggtcaccgttacccgggtaccggcatcgggctggctggcgatggcgatggcgccgccgtgcatttccatgatggccgccaccatgggcagccccagaccagtgccctcgtgccgtcgggcgatgcgggcgtccacctggacgaagggctcgatgacctgggccgcctcttcctcggtcatgccgatgccggtgtcgctgacatgcagctccaacccgccgtcgggagtgaggctggcggaaacggtgaccctgccgccaaacggcgtgaacttgacggcattggccagcagattgatcaccacctgccggatccggcgttcatcggccatcacctgggggaggcccgggggaaggtcggagatcaaattcaagccggcggcggcgccgcggtcacgcagcagacgcagggcgacgtcgaccaccggggcgatttccatggggcggtcgtccagctccatccggcccgcctcgatcttggccagatccaggatgtcggtgatgatccccagcagatggcggcccgaggcggagatatcgccggcatattcgcggtagcgctcgggcatggggccgaggacctgggaatacatggtctcggcgaacccgatgatggcattgagcggagtccgcaattcgtggctcatgccggccaggaagtcgctcttggcgcggctggcgctttccgcctgctccttggcggcgcgcagttcgtcctcggcccgcttgcgccagctgatatcctcggccaccccgatgatgtactcgacctgaccgtcgcggcgcagagccgacacggtcaggttggcccagacgatcgtgccgtccttgcggagatagcgcttctcgatgctgttgctttcccgggtgccctggatgatgtggtcgatgccgtccaatcccagcttgcggtcgtcgggatgggtgaagtcgctggcggagcggccgatcagttcctggggcgcgcagcccagcatctcggcgaaccggctgttgatgcggatgaaacggcggtccagggtcgtgtggcacatgcccaccgccgcctgctcgaaggtggcgcggaagcggtcctcgctctcggtcagccgagcctcgcgttcgttcagggcgccgaccatggtgtcgaaggtgtcgcccatctcgcccacttcgccgatgccgccgccggcgcgggcggccatgtcgccggcccgcacccggcgcatggcgccggccagccgtcccaggggctggaacagcaggcggcggctggaataccacagcagcaggacggcgcccgagccggcgatgccgaaggcggtgaccgccatgcgcaggaactggcgttccgaccctcccagcatctccacgggcatggtcaccgccaccatggtctcgggcgccatgcggcccaggggggcgacgccgaagaccgaggtctcgccggtgatggcgatggcggtgaaagatccgccgcggccccttgccgccgcctccctcaattcggggaccggggtgatggccggggcgtcaccggaaagggcgggcacgcgggccaggacggtgccgtcggatttcagcaccagcaggcgcgccccgtcgggcaggatgggcggggccaccgccttggccagatggtccagcgaccgggcggtcgccaccacgccgcgcggcgtgcccagccagtcgagaatgggataggccatgggcagggcgacccgcccatcctcgagctggacataggggccggtggcgaaggctccggtttccatggcgcggccgatctgcggtcccttggtcagccaggagatatcggtgccctgggcgatgctgcatcccgcccgcccggacgggtccgtgcgcaagaagccgtaatgcccctccacggccagcaggaagtggcggtaatggctgccgcattcgtcgtcttcgggatcggtggccagggcggccagggcctcgcgcgagctttccaatccgcggtcatgaatggcggccgccatgcgggccagggtttccacctgggagcccgccgcctgcagggacagggattccgccagctggatgatgatggccagggtgccgaggaaaactgcgggaacaaggcccagcaccaccacctggaacaggtggccccgtgctccgcccagccaggtcagggtccggttgcccccctccgccattcggtcctgtttccctccccaaagcggcccataccctatcacagggtggcggcaatccaatatcggctatccgtcactagcgtgtgacagtcatttggtgcgggggccgttccgattcaggtcgcgcatggccccgtcgaggccttccagggtcatggggaacatgcgcccgtccatcaattgctggatcatctgggtggagtgggtccattgccagcgggcctggggcgccgggttgagccagacggcgctgggccattggtcgagcaggcggcgcatccagacgtgacccggctcctcgttccactcctccaccgcgccgcccggcatggtgatctcgtaggggctcatggcggcgtcgccgacgaagatcagcttgtagtccgacggaaaggtatggatgacgtccagggtgtgggtgacgtcctggtggcggcggtgattgtccttccacaggccggaataggggcagttgtggaagtagaagtgctccagatgcttgaactccgagcgtaccgccgagaacagctcctcgcaggtgcgcacgtgctcgtccatggagccgccgatgtcgagcagcagcagcaccttgaccttgttgtggcgttcgggccgcatctgcaggtcgagccagccgcccgcccgcgccgtcgaggtgatggtcccggccaggtccagctcggtggcggcgccctcgcgggcgaagcggcgcaggcggcgcagcgccatgcggaagttgcgggtgcccagctcgatgccgtcgtcgagattgcgataggcccgctcgtcccagaccttgacggcgcggcgatgccgggattcgtgctggccgatgcgcacaccctcgggattatagccataggcgccgaagggcgaggtgccggcggtgccgatccatttggagccgccctggtggcgctccttctgctcctccagccgcttcttcagggtttccatcagcttctcgaagccgcccgccgactggatctgctccatctcctcgggcgtcagatgcttttccgccagcttgcgcagccattcctcaggaatggcggccttcagcgcggcggccagttcgtcgccttcccccaccacgccgttgaacacgcgggcgaacacccggtcgaacttgtccaggttgcgctcgtcctttaccaggcatgagcgcgagagatagtagaaggtgtcgacgctcatctcggccacgccttcggccagggcctccagcagggtgaggtattccttcaaggtgaccggcaccttggcgtcgcgcagttcgaggaacaggttgaggaacatggcgggtctcagccgccccgcgctcgggtccaggcggcgtagcgctggtcctcgatcaggatgtgccccttcagccaggaccacaggaagtccttcagcctcgtatcgccggcgtcgaagggacgctcgcgatactccttcagcatggccgccacctgatcggcgaagtcgtcgtgctggacgcggtgggcgtccaggccgggaaagccgatggcgtccagatgggtttcctcgcggtcgaaatggccggtggtgtagtcgaggacggcgttgaacagctccaggaagtccggagccgactggtccagctcattgatcatgcggatcagcttctggtggtccttgtccagggcggggttgtccacgctcatggcctcggtccacgcgatgatgctcatcagcgtccctcccgccggctgagaaaggccagacgctcgaacaggtgcacgtcctgctcgttcttcagcagggcgccgtgcagcttggggatcagcgtgcttttgtccttggcgcgcagatcgtcgggggacaggtcctcggacagcagcagcttgatccagtccagcagttccgaggtggacggcttcttcttcagccccggcacctcgcggatgtcgaagaatacggtcaggcctcgtgcagcagggccggcttgatgcccgggataatgcacggtgacgatccgctccatggtctcgcggtcgggaaagcggatgtagtggaagaagcagcggcgcaggaaggcgtcgggcagttccttctcgttgttcgacgtgatgatcaccatgggccgcttgaccgccttgaccacctgcttggtctcgtagacatggaattccatgcggtcgagttccagcagcaggtcgttggggaattcgatgtcggccttgtcgatctcgtcgatcagcagcaccggcggggtgggggcctcgaacgcctcccacagcttgccccggacgatgtaattggagatgtcgtggacgcgctggtcgcccagctgcgagtcgcgcagtcgcgccaccgcgtcgtattcgtacaggccctgctgggccttggtggtggatttgacatgccattgcagcagggggcggcccagggccttggccacttcggcggccagcacggtcttgccggtgcccggctcgcccttgatcagcagcgggcgctcgagacgcagcgccgcattgacggcgaccagcaggtcttcggtcgccacatagctatcggtacccttgaacgacatggactcactccttctccaagagaaaggtaggagccttgatgaaatcggtcaaggaatgccgatttgaaaaacgcaaagaaaaagccccggccttgggagggaggccggggctcgtatccgtcgtcgccaatgtccggaagcagcgggatgggggggagagccccggacattcaatgggcggcggcggggtcttatccgatccaggtccgtcggaggtgggaggaacctcgacggacccgttggggatcggattaagcggcaaccttggtcagggcggcgaaacgggcctggatcggctcggccgcggcggtcagggccgaggtggacagctcggccagcttgcggccgtcggcgatggcgctctccagggtctcgcgggccagcttgccctgcaggtcggcgaactcggccgggctcttcacggagaacagagccttgacggcggcgtcggccttcttgacgttctcggcgatcagggcctgctgggccttggcgatctcttcgaaggccttgacggcgatggcgccggacttggcgaaggcgtcggcattgtccttgcccatggaaacgaacttctcgaagccgtcgatcttgatggtcatgtgcgtgatccttatctggggtgggcgcgttgtgcgctgcaacatgacgtcaatctaacagaaccatgccgcagtgcaacatgattttcgcactgcaacataactgtcgtgcatggagggggtgcaaaaatgcaaacgccccccggaatccagcgattcccggggggcgtcgagggaaaaactaccgcgtggcggccacgtcgcgcagcacgttcatctccatctgggcttcggtcagacggaagttgaccgcgtcgccgatggagacgatgccgaccagttcgtccttttccagcaccggcagatggcggatgcggcgttcggtcatcacacccatgatggtcttgacgctgtcgccgggcgagcaggtcaccaccgggctggacatcacgttgcgcaccggcatttccagggcggccttgccgtactgggccaggcccttgacgatgtcgcgctcggacagcacgccctgcagtttgccccttggcgtcgcaaaccacggcgacgccgaccttcttgttggtcagcagcgccgcggcatcggccaccgaatgctcggggcggatggtgaagatgacgctgcccttggtcttcaggatggtttcaacggacatcggtggtccccctttatctcttggctattgaattattgcggaggggagaccggtccccgaccccctaccttcgaataatattagtctggaggcgaaccgggggaatttcaagccaccatcagtgggtatgccccagactcaccccgctggccgccagctggtcggccagggtctggcgcaggtgcttgagcccctcggaactggccgcctcgcaacgggccaccagcaccgcctgggtgttggaggcgcgcagcagccaccagccgtccggggtatccacccgcacgccgtcgatggctgagaagctggcgccctcggcctccagacgggctttcacctcggccaccacggcgaactttcgctcctccgggcagtcgaagcgcagttccggggtgttgaccatgtggggcagcctgtcgcggcgctggccgatggtcgtgtgatcccagcgcgccacgatgcccagcaggcggatggcggcgtaaagggcgtcgtcgaagccgtaatagcggtcggcgaagaagatgtggccgctcatctcgccggccaggggggcgccggtctcggccatctgggtcttaatcagtgaatggccggtgcggcccatgacggcgttgccgcccatgcggcgcacctcgtcgaagaacaccttggaggccttgacgtcggcgatgatggtggcgccgggcagggatttcagcagatcctcggccaggatcaccaggatctggtcgccgtagaggatgcggccctcggcatccaccacgccgatgcggtcgccgtcgccgtcgaaggcgatgcccagatgggcggattcggtcagcaccttgtcctgcagcgccaccagattgtggggctcggtggggtcggggtggtgattggggaaatgcccgtcgatctcgccgaacagcacggtatgggtgccgggcaggcgcttgaccaaggcgtgcagcacctcgccggtggcgccgttgccgcaatcccacactacccgcaggtcgcgcaggccgtcataatcctgggccaggcgggacacgtattcctcgaacaccgaatcctcgacggccttgccctcgccgctggcgaagtcgccggcagcggcgatggtccccagcgactggatgtcggggccgaagaacggcctgccggccagcaccatcttgaagccgttgtggttgggcgggttgtggctgcccgtcaccatgatgccgccatcggcgtcccgcaccttggcggcgaaatacagcatgggggtggggccgcgcccgacacgccgcacggtgcagcccgccgccatcaggcccttggtcagcgcctcggccatctcggggctggataggcgaccgtcccagccgagacagaccacatggccgccattgcggcgcacccgcgtgccgaaagcccggccgatggcctcggcgtcggcggcgaacagcgtctcgccgataatgccgcggatgtcgtattcgcgcaggatggtggggtggaagatgtgggtcatgtcaggtaatcaccgtcggttcggtccgtccggtccgggcctcgatctgggccaggtcgcgggcgattgtgatgaggtcggccagggccacctgggggtccagatggtgcttggtggcgtcgggttcaaagcgctcgatgtagacgcgcagcgtggcgccctcggtgccggtgcccgacaggcggaagaccacgcgggagccgtcctcgaataccacgcggatgccctgcttcttcgagacagagccgtcaacggggtcggtataggcgaagtcgtcgttgaaggcgacggtgtaggtcccgagccgctcgcccttcagggacaggccgcgcagatgctccatcagcccttcggcggcggcggaatcgatgccctcgtaatcatggcgggaatagacgttgcggccgtattcccgccaatgggcggtaacgatgtcggcgacgctttgcttgcgcacggccagcacgttcagccaggccagcaccgcccacagcccgtccttctcgcgcacatggtccgagccggtgccgaagctttcctcgccgcagaaggtggccttgcccgcgtccagcagggtaccgaagaatttccagccggtgggagtctcccaggcgggaatgcccagcttggccgccacccggtcgggcgcggcgctggtgggcatggaccgggcgatgcctttcaggccccgggcatagccgggacacagggtggcattggcggccagcaccgccagggaatccgacggcgtcacatagaagtcgcggcccagaatcatgttgcggtcgccgtcgccatccgaggccgcgccgaaatcgggggcgccggcaccggtcagggcctccaccagatcatgggcatggaccagattggggtcgggatggccgtggccgaaatcttccagcggcacgccgttcatcacggtgcctttgggggcgcccaggcgattctccaggatctcggtggcataggggccggtcaccgcgtgcatggcgtcgaacttcatgcggaacccggcggcgaaggccgcccggatggcgccgaagtcgaacaggctttccatcagctcggcataatcggcgacggggtcgaagacctgcaccgtcatgccgcccaggccgcgctcgccgatggtgtccagatccacatccgccgcttcgatgatcttgtaggacgagatttcctgggtgcgggcgtagatggcctcggtgatggcctcgggcgccgggccgccggccgggatgttgtacttgatgccgaaatcctcgtccgggccgccgggattgtggctggctgacaggatgatgccgccgaaggtcttgtacttgcggatgacgcaggacgccgccggggtggacaggatgccgccccggcccaccatcaccttggcgaagccgctggcggcagccatcttcaggatggtctggatggcggtgcggttgtgatagcggccgtcgccgcccaccaccagggtcttgccccccaggtctccaatggagtcgaacaccgcctggacgaagttttccaggtagtggggctgggcgaagaccttgaccttcttgcgaagacccgaggtcccgggcttctggccggaaaagggggtggtggggatcgtcttcactgcggccatggcgcggggctcccttccgacaaaactgcttcggcgttgatggccgatggcggggcaggtgtcaatggcgcaggaaaggcggcaaattttacgagataagatattgcatgaagcccctatagggatatggtcatcattggtgtacatgcaggaggcttagttgtctggatgtgaatctcttgatggctatgagccggaggctctggcggcggcgggggtggtcatcggcggcacggacgtgccctatccgcccatggcggtgccgcgctacaaggcggtgagcggccccaactgggccttgcgcgagatgttcctgatcgcggcgcccggctatttcagcggcccccgccaactgaactggatgaatgccggtctggtgcgcgacggcgaatgctggatgagcctgactcccggcgagatcgaaagccagatgccgcatctggcggcggcgcggggcaaggtggtggtctgcggcatgggcatgggggccatggcctatgcggtgtctgcccgtaaggcggtggagcgcgtggtggtggtggaccgggaccccgaggttatcgccatgttccaccagttcgcggccttcgacacttggccgcagcgcgacaagatcgacatcgtccaggccgatgcccgcgaggtgcgggtcgacggcgtggacttcctctatgccgatatctggccgtattaccgcatggattgcatggtgccggacatgcaggccatccagggcaacatcaaggcgccgcgctgcggctattggggccaggaactggacatggttgaccgggcgctgtcgcgcggcgtggcgcgggaggatttctccgccgcccatgtggaggccttcatcgcggagaccggcctgccgctgatcggcctggaggagccggcctatccggaattgtgccggcgggcgtcggtcaatcccgccatcggccggaacaggcggccgatggcggaggcttgatggattacggacggccgatgctggaataggcgaagcccagttcggccatttcctcggggacatagacgttgcgcaggtcgacgatgctgggctgggccagcagcgacttgaccttcttgaggtccagcgcccggaactcgttccactcggtgatgatcacggcgcaatgggcgccgggcatggtggcgtaggcgtccttgcaatactcgacagcggcgggaagcagctttttggcttcttccatgccctccgggtcgaaggccttgactgtggctcccgcctcgatcagcgccgagacgatgtcgatggagggggagtcgcgcatgtcgtctgtgttgggcttgaaggtcaggcccagcaccgagatggtcttgcccttcaccgagccgccgcaggcggcgatgacccgctcggccatctgcttcttgcgggcctcgttgacggcgaccaccgtctcgacgatgcgcaagggggcgttgtagtcgcgggcggtcttgaccagggccagggtgtccttggggaagcacgagccgccatagccggggccgggatgcaggaacttcttgccgatgcggccgtcgaggccgatgcccttggccacgtcgtgaacgtcggcgcccaccttctcgcacagatcggcgatctcgttgatgaaggtgatcttggtggccaggaaggtgttgccggcgtatttgatcagttccgaggtgcgccgcgacgtgaaggcgatgggcgtctcgatcaggtacagcacccgatagagctgcttcatcaccttgcgggccttctcggactcggtgccgatgaccacgcggtcgggccgcatgaagtcgttgatggccgagccttcgcgcaggaattccggattggagaccacgtcgaactgggcatcgggacgccgtgcccggatgatgcgctccacctcgtcgccggtgcctaccggcacggtggacttggtcaccaccacggtgtagccggtcatggaatcggcgatttcctcggccgcggcatagacgtagctgaggtcggcatggccatcgccgcggcggctcggcgtgcccaccgcgatgaacaccgcgtcggcatccttgaccgcttccttgaggtcggtggtgaaggacaggcgccccgcctccacattggcggcgaccatgtcgtccaggcccggctcgtagatgggcatgatattctggtgcagcttctcgatcttggccgcgtccttgtcgacgcagaccacgtcgatgccgaattccgagaagcaggttcccgacaccagacccacatagccggtgccgatcatggcgatgcgcatggggcgtcagtccttatggaagcgggtgatcaggtcgcgggcggcctcggcggtgtcgtcacgggccagggcaaaggcgaggttggcttccagccagcccaccttgtcgccgcaatcgaagcggttgccctcgaagcgcaggccatggaagggaaccataccgatggtctggctgatggcgtcggtcagctggatctcgccgccggcacccttctccttcttgtccagcacgtcgaacacggcgggatgcaggatgtagcggccgatgatggacagggtcgagggcgccacgtccggatcgggcttttccaccaggcccttggcgcgggccaggcggccgttgtcgtgttccacgtccaggatgccgtagcgcttggtatgctcgcgcggcacgtcggagacggcgaccacgtggccgcccacctcggtgtgcacggcggccatctgcttgaggcaggcggtcttggagaggatgaggtcgtcgggcagcagcacggcgaagggctcgtcggccaccaggtcgcgggcgcaccacacggcgtggcccaggcccaggggctcggactggcgggtataggaaatctggcccgacttgggcatccaggaggtcaccgcctccaccagatcgaacttgccgcgatccttgaggatgcgctccaactcgggattgtggtcgaagtgatcttccagcgcgttcttaccgcgcccggtgacgaagatgaagtgctcgcacccggcggcggccgcctcttccaccgcatactggatcagcggcttatccaccaccggcagcatttccttgggcatcgccttggtggcgggcaggaagcgggtgcccatgccacccacggggaacacggccttgcggactcgacgagtcatcgatcactcctgaaagctttgtctcgaccgcccggcgcacgtcatggcgtctcattacggtcgcggcatgttttgccacgccctggcgtcggaagcaacggttaggcgggaaaatcagcccagtagaatgtcgcgggcctgattgagacgggcggcgatccaggtggacccgccggtatccgggtgggcggcgcgcatcaggcggcggtgcgcttcgcggacgtcgtcggagctggcgccgggcgacaggcccagaacctccagggcctgggcacgggtcatggcggtgtcggcggggggcgagggcggcggcggggcggcttcggccggggcgtcgcggccggtcatgcggcgaaaagcctgccacatctggtgcaggcgcatggcccggccgatccagggcgagaggcccgccagaatggcgaacagcccggccagcttgcccgtcgccaccagggcgacgccgccgatcaccagcagggcgagggcggcggcgaccagggcctttttcgtctggtcgggcgaggccttgcgccaccagtgccaggcccaccacagggcgaggcctccgccgatcgccagaagcaggcgcagaatcatggaaggggactattcgaagtgaaagctggaatcgccatcggtcagttcgaacagccgccggacatttcccgaagcccctcgcagggtgaggtggcggccattgctgacgatctcgtccttggccagatggagcattcccagtccgacggaatccacccgcgccaccttggtcagatcgacgacgacccgtgccgccttgatggagccgatgtcgctgatcaggctgttcatctggctggtgaccgtatagtccatggtcccgtcgagacggacggtcagggtgtcgtcctggtgggagatggagatgttcatgtgatactcgaattcctcggtggcccagcgcgtgagtatgctacgacttttcttatggctccacgggcggaatgaggcaaattgtatctggtccataggtgttttccggtggatcgcccttggcgtgaccgcggcttcgcggtaaaaacgaacaagtgatcgtaaagctcggaggaagcatgtccgtcttgctgtggcaaccgtccaaggagcgtgccgaagcttcggcgcttgcccggttcatgcgccgggcagacgcccgctttcaggtgggtgcgaccgactatgcggggctgtggcgctggtcggtggatcgccccgaccagttctggtccctggtgtgggacgaggtcgggatcatcggcgaccgccccgacggcggagtggtggtcgacgatgctggccgcatgccgggcgcccggtggtttcccgaggcgaggctgaacttcgccgagaacctcctgcggcgcgacgatggcggcgacgccctggtgttctggggcgaggacaaggtcaaacggcgcctttccttcgccgagctgcgcgccctggtgtcgcgcctccagcaggcgctgagtgcggccggcgtgggcaagggcgaccgggtggcgggctacatgcccaacatgccggaatccgtggccttcatgctggcggtggcgtcgttgggggccatctggtcctcggcctcgcccgatttcggcgtccagggcgtgctggaccgcttcggccagatcgcgcccaaggtgctggtggcggccgagggctatttctattcgggcaaggcccatgactgcctggagaagctggcggccatcgtgccgggcattccctcgctggagcgggtggtggtggtgccctatacccgcgaggcggcggatctgtcgggcgtggacaaggcggtccatctcggcgacttcctggcgccctttccggccaaggcggtggagttcctccgcctgcccttcgaccacccgctttacatcatgtattcgtcgggcaccacgggcgcgcccaaatgcatcgtccattcggcgggcggatcgctgatccagcaattgaaggagcatcggctgcattgcgacgtgcgcaaggatgaccgggtgttctatttcaccacctgcggctggatgatgtggaactggctggtggccgggctgggggccgaggccacgttgctgctctatgacggcaatcccagccatctgggcggcaacatcctattcgacttcgccgacgctgagggcatgaccctgttcggcacctcggccaagtggatcgacgccatcgccaaatcggggctggagccgatcaagacccattcgctcgccacggtgcgcaccatctgctccaccggctcggtgctggcgcccgaggggttcgactatgtctacgccaaggtgaaggcggacgtgcaactggcctccatctccggcggcacggacatcatctcgtgcttcatgctgggcaaccccctggttcccgtctatcgcggcgagatccaatgccggggcctgggcatgaaggtggaggtcttcgacgagaatggccagtccttggccggcagcaagggtgaactggtctgtacccgggcgtttccctccatgccggtgggcttttggaacgatgacgacggcgccaagtaccgcgccgcctatttcgagaagtttcccggcatctggacccatggcgactgggtggagcttaaccccgagaccggcggcatcatcgtcttcggccgctcggatgccaccctcaatcccggcggcgtgcgcatcggcaccgccgagatctaccggcaggtggagcagatcgacgacgtgctggaaagcctggtgatcggccaggactggcaggccgacgtccgggtggtgctgttcgtgcggctgcgcgacggggtgacgctgtcgccggaactggagacgcgcatcaagaagcgcatccgcgacaacaccacgccgcgccacgtgccggccaaggtggtgcaggtggccgacattccccgcaccaagtcgggcaagatcgtcgaactggcggtgcgcgacgtggtgcacggccgcgcggtgaaaaacaaggaggccctggccaatccggaagcgctggatctgttcgccggacgcgccgagttggaggagtgatggacggcaggccgattcgacgatagccttccccttcaagtttgtttgacgggaggggttcatggatcgtcgttcattcctcaagggggctaccggcgccgcttgcctgtgcgggacctgcggcggctctattgccgaggcggtggcggccgagggggctcactgggcctatgagggacatggcggccccaaggaatggggcatgctgtcgccggaatacgccgcctgttccatggggcgcgagcaatcgcccgtcgacctcacccggcccatcgccgccatcatcggcgatcccatggccgcctggcggccggtgccgctcagggtgcagaacaacggtcacaccatccaggtggattgctccggcggcggcaccctgatgctggacggcaagtcctatgacctgctccagttccacttccatcatcccagcgagcacacggtggacggcgccttcttcgacatggaatgccatttcgtccacaaggccgccgacggtgggctggcggtgctgggcgtgatgatcgccaagggggccgccaacccggccctggaagccatctggcaggtgatgcccgccaaggcgggcgaggcggccacggcgacttccatgctcgacgcctccatgctgctgcccaaggacccggtgaccttccgctatgccggctcgctgaccacgccgccctgcaccgaggtggtgcagtgggtggtctaccgtcaggccatcaccgcctcggccgagcagctggccgccttcgccaagctgttccccaacaatgcccgtccggttcagccgctcaatcgccgcaagctgctgctcgacgtgatgtgaggtgagtgatgacgcatcggctttcgcctcccatcctgtcgcttggcgccctggtcctgctgggcggctgcgccgcgtctccccagcccatggccggggcgtggcataacggcacctggatcgtcaccgacgccttcgcctcgggggcggtcgccgattccgcttcggcgccgcgggggcaggccgttcccatggaaccaggccgggcgggaaatgccgccggcggggtctgcctgacgccgcgttacctcgatgaccgggcgccgctgtcctcggtggtcggggcctcggcccccgactggccgggcatggcggaccaggtcgcggttctggtggtcgaatgcgacggcaagcccttcgcccgctatgccgccatgggagacggcgccctggtgacccgctacggcgcctgggtgctgcggctcgaacatggcgagaagctggccgccaatcccgcgcccatgatggccgaaccggccgcgccgcccacggtggtggccgccgtgccggcggtcgcgccgcccgcgccggctcccgaggcgccgcgcaagctggtctatctcgcctcgtacaagaccgaggcctgggccaggaaaggctggggcatcctggccgagcgctcggccagcctcaagggctccgagccggtgatgaagtccgtcgacctcaagggcaagggcaagttcgtccgcctgttcgccggcgccaaggacgagggcggcgccaagctgatctgcaaggaactgggcaagaccatcgccgaatgcggcgtgaccggacgggaatagggcttggcaagctgcggaagaaacgtcacttcgggggcttttgcccccgatcccccaaccgggaagcacagcttcccggacccttcagttttttaatccattgaaataaagagaagcttgaggttcggaggctgtgcctccgaacgggtcagggcggtcgccctgccgcaaagcggggttcttccgctgccggctagaaccggtatcccaggccggcgcccagggtcacgccggaaccggcggactcggcgctgttgctccgattggctccggccatgccgccgacgctgaacgacgggctgacctgatggatcaggctgagcgacatgttgatgtcgctgccgccgccacgggcgccgccgcgatagggatcggccagggtcagggcagggtgctgggaattggggctaatgcggctccagtcggtgctgctgactcccaggctgagggctgcccggctatcgttgccgagaacgccgccgccccacgaggccgccatttcggccgcccgggtggcgccgtcgctgcgcagcgacgacgacaattgggcgccggagccgccaaaggccacatagccgcccaccgccagctggcttcccggaaggccgaaggccagcggatggcccgacaggctcgaggtcggtcccgacagggcgcccgccgagagcttgcccgccgagatcaggggcagtcgggtctcgcccaggccgaaggccggcgcttcggcgcggacggcgccgccccccggaaccagccgggcggccggcgacaattccgccgaatccgccgcacccgctgcccacaggggcagcgccaggacggtaaacagggcggaacgcatgaacgtcatgacgggatcggggtaaaggtgtatcgcttcggaaagatataatcaccccaacggccttggggaagtccccgggccggcttggcttttgattctggcgaagtgttgcagttttgcactgcaatatggattcaggtcccggcgggcttctcgccgatcaactggcggatggcggcgctgccgctgtcgggcgccatgacggcggccagccagggcagcacccggtcgagagactcccgcaattgccagggggggttgatcaccagcaggccattgccgttgagcttgaacggatctttggccggacgcagcagcaattcggccgccagggcttccggcccaccgtcgtcggctatggcctgaaggaactggtccaccggctcgcggcccttgatggggtaccaggcgagatagatgccggtcggccacagcttgcgggcgcggcgcagggcggccagcaggcgttcgaactcgttcttgacctcgaagggcgggtccatcagcaccagcccgcggcgctcgggtggaggcagcaagcccttggcggcggtatagccgtccaaatgatgcacgcccacccggcggtcgccgtgaaagcgggcgcgcagcgtctccacgtcctcggggtgcagctccaccaaggccatgcggtcctgggggcgcatcaggccgcgcatcagttcgggcgagcccggatagcggcgcagcaccccctcggaattccacgtccgcaccagggccagataggtctccagctcggcgggcggatcggcggcgtcgagaacgcgggcgatgccgctcaggtactccccggtcttgtcggcctggggggcttccaggtcataggcgccgatgcccgcatgggtgtcgagggcgaaaaacggcgtgtccttgcgcttcaggctggcaacgaccatggccaggatggcgtgcttcatcacatcggcgaaatttcccgcgtgataggcgtggcggtagttcattcccggctctcgtgggtgtggcgctggcggggcgcgagcataggcaagtggcggtgggacgcaaaggaaaagcagcggaatgctatagtttaaagttattctaagcaaagtcagcgaaggctgtgcccgcggtaaataggtcgatgcatatgccgatgagtaagtggtagcaccatacaatggtatgtgttctcaacggagaagtaaccatatgaatggaagggaaggcgcagagggaaactgtgcatcccaaatccatctccagcaaagatggcgttacatttcgacatattcttggtcaccatcccgacacattcttgttcatagtatcgaaactgtttgggtgtaatatccgctccggacagaccctggactcagggtcgggattgcaatgtgcgggtagctacccggcgtactgccaatgcggggaattgtcatgtcgcgtcctggtgtttacttgtcaggagtagagcgtaccttcggtgccgacgagatcatcgtcagcaagaccgataccaaggggcggatcatctacgccaacgaggtctttctgcggatggccggcttttccgaggccgaaatcctcaacaaacctcacagcatcatccgccatcccgatatgccacgctgcgtgttcaagctgctgtgggacaccatcgaggccggcaaggaaatcttcgcctatgtaaagaacctgtcgaaaaacggcgaccactactgggttctggcccatgtgacgcccaccttcgacaagtcgggcaatatcgtcagctatcactccaaccgccgttcgccccggcgcgatgcggtggagaaggccgaggccctctacaaggaattgctcgccatcgagaacagccactccgaccgcaaagtcggcatggaggccgctttccaggctgtggttgccaaactgcaaggcgcgggagtgccctacgatgaattcgtcttctctctctagggctttggccgccacggccctggcggcgctgctgtgcggcgtgggcgcggtgatcgcgcttagccgcggagcgctgctggatgccggggccatggggctggcggcgctgggcgccctgggggccctgcttttcatcaaccgggcgcgccgctcggtccaccgggcctgcaccatcctggccgaggccggtgccgggcgtctggacgtgcgagtggtcggcatcaccgaaagcggtgtgctcggccaattggacaaggcgatcaaccggctgctcgacctgaccgaggctttcaccaaggaggccgacgccgccatggcgctgacctccgaggggcgctatttccgccatatcctcaccgacggtctggtgggcgagttcgccgaccatgcccgcctgatcaaccaggcgctctcccagatggaaaagcgcgccctggccttcagcaccgaggccaccggcgtcggcaacaccatcaagcacgtgacccaggtggtggcttcgaccgccaccgaactggaagccaccgcccagcagatgtccgacatcgcgtcgcagacctccgagcaatcgacccgggtggccggagcggcggaagacgcctattcccatgtggaatccgtggcggcggcggccgagcaggtgtcgtcgggcattcgcgacgtggcggcccgcatccaggattcggcccgcatggcccaggagacggtgcgcgtcgccaccgaaaccgatgatgccatcaacggcctgaacaccgccgcccagaagatcggcgaagtggtgagcctgatcaccgagatcgccgcccagaccaatctgctggcgctgaacgccaccatcgaggcggcgcgggcgggcgaggcgggaaaaggctttgctgtcgttgccaacgaggtcaagcatctggccaatcagacggccagggccaccgacgagatctccagccagatcgacggtatgcgccacgccaccggtcaggcggtggaggcggtgcgcaacattgccggcaagatccgcgagatcaacgacaacgccaccggcattgccgccaccaccgagcagcagagcgccgcagtggccgagatgagccggtccatccgcactgtggccgccgacgtgcagaccgtggccgacaccatcggcgaagtggcctccaccgccggcaccgccaccgacgccgccggtcaggtgctgatcgccgccggagatctggccagccgcacggtcagcatgaacgacgacatcgacgccttcatctcgcgggtgtgctcggggatcaagggggggtgatgcccgcccggcgatgagggcgcctgttaaagttccttgcgtgccggaagcacttccgctaatgctacgcttccgatggaggaagtgatgttcgtctgcttgtccaaggcaaacggttcccacgcccggggttcagccccggcggcggccttcgtcactactaaaaccggcaccaccaagaccgcttgagcgggccggttcgtcacgattgcacgaaaaaggcccgcggcaagtttcccgcgggccttttcgcatgcgaagaagcgccagggattgcaggggctcctggagacacggagaagagaacatgggttacaaggttgctgtgatcggcgctacgggcaatgtgggccgggcgatgctgcagattctggtggatcgcaagtttccggccgacgaggtcgtggcgctggcgtccgagcgctcggtgggccgcgaggtctcctacggggacaaggtcctgaagtgcaaggacttggccaccttcgacttcaagggctgcgacatcgccctgtcgtctcccggcgccaaggtctcggccatccacagcccgcgcgccgccgccgccggctgcgtggtgatcgacaacacctcgcatttccgcatggagcccgacgtgccgctggtggtgcccgaggtcaacccggatgccatcgcccagtacaagaagcgcggcatcatcgccaatcccaattgctccaccatccagatggtggtggccttgaagccgctgcacaagctgggcaagatcaagcgcgtggtcgtttccacctaccagtcggtgtcgggcgccggcaaggaaggcatggacgagctttacgaccagaccaagggcatcctggtccatgacgccatcaagccgcagaagttcgctaagcagatcgccttcaacctgattccccagatcgacgtattcatggaagacggctcgaccaaggaagagtggaagatggtcgtcgagacccacaagatcctcgaccccgatatcgccgtcaacgccacctgcgtgcgcgtgccggtcttcgtcagccactcggaatccatcaacgtggaattcgagcgtccggtctccgtcgccgaggccaccgaggccctgcgcgaggccgagggcgtggtggtcatggatacccgcgagccgggcggctacatcaccccgctggacaccaccggcgaggacccggtctatatcagccgcatccgcaaggatcccaccgtcaagaacggcctgtccttctggtgcgtcgccgacaacctgcgcaagggcgcggcgctcaacgccgtgcagatcgccgaagtgctgatccgcgactacctgaagaagtagtccgcccaagggcgcgacgtggaacggccaccctctccggggtggccgtttgccgtttcgggcggctgggtttatcctgcctgcatgagcgagccatccgcaccagacgtggaaatccgcatcgagggtctgaccaaggcctttgatggacatgcggtgctgcgcggcgtggatctagatattcaggccggggcctttgttgcggtggtcggcggttcgggctgcggcaagagcgtgctgctcaatcatattctgggcctgatgcagccggattccgggcgggtgctggtggccgatcccacggtggccgaggggccgctgctcgatctggccgtcctggacgccgaccgcatgtccgacatccacacccactggggcgtggtgttccagcgtaacgccctgttttccggcacggtgctggacaatatcggcctttggctggaagaggtagggcacctggacgccgccgacatcgagaagatggcgcagcgcgtgctggcggcggtggggttgccgtccagtgccgacttcctggccgggcgggtggaggcgctgtcgggcggcatggccaagcgcatcgccattgcccgggcgctggccatggagccgcgctgcatgttcttcgacgagccgaccaccggcctggacccggtcaccgcctcgcagattcaggacctgctgctgtccacccatgtggacgagcgcgacggcaaggcgcggaccaccgtggtggtgacccacgacaaggacctgctgtaccggctgcggccgcgcgtggtcatgctgcacgaaggccgggtgtcgttcgacgggccgttcgaggcgttccatgcttcgacctcgccgatcatccgtccttatttcgagctgatgccggtgctgcatcagaggggccattcctgatggccacccatctgccgacgctccgccagttgcgttatctggtcgccctggccgagcaccgccatttcggccgcgccgccgaggagtgcttcgccacccaaagcaccctgtcggccggcttgcaggagctggaaagcctgctgggcgccaccctggtggagcggaccaagcgcaaggtgctgatgacgcccctgggcgaggaggtggtgacccgggcgcgggacctgctgcgggccgccgaagacatcgctgacctggcccgggccggcggcaagcccctgtccatgcgcttgcgcctgggggtgattcccaccatcgcccctttcctgctgccccgggcgctggcccggctgcggacgctttaccctgatctcaagctggcgctgcgggaggacctgaccgcccggctgctggaccggctggccagcggggagctggatgccgcggtgctggccctgccctacgaggcctcggagatggagatggtggcgctggccaccgaccccttcgtgctggtctgtccgccgggtcaccccctggccgccagggatgcggtgaccggcggcgatctggccgaggcggaattgctgctgctggaggaggggcattgcctgcgcgaccatgccctggccgcctgttccctgccggcgcccaagcggggcgagggcgtgctgggcacctcgctgggcaccctggtgcagatggtcgcctccggcatgggggtgacgctgctgcccatgctggccgtggatgcgggaatcctggcggggaccggtctggtgacccggcccctggccatggggggctcgcgccgcctgggtctggcctggcgcaagtccagcgcccgcaaggacgaattccgcctgctgggcaatgttctgttcggaaggtaacccgggctatcgcccggacccatctggggcagaccccagaccccttccattttcaaaaatatgggaggcttggaggctgagcctccaaccggggccggggcgtgagccccgttatcccctagtcgaacaggctggagaccgagcgttcctcgctgatgcgcgagatggattcggccatcaggggggcgatggtcacctgccggatgttgcgggccatcttcaccgcctcggtggcggggatggaatcggtgatcaccagttcttccaggggcgaagcggtgacgcgggccaccgcgccgcccgacagcacgccgtgggtgacgaaggcggcgacggagacggctccggccttcatcagcgcctcggcggcgttgcacagggtgccggcggaatcgacgatgtcgtcgaccatgatgcagcggcggccgcgcacgtcgccgatgatgttcatcacctcggacacgccagccttttcgcggcgcttgtcgatgatggccagatcggcgtcgatgcggctggcgatggcgcgggcgcgcaccacgccgcccacgtcgggcgacaccaccatgacgtcgtcgccctggtagcgggcgcggatgtcgttggtgaacaccggggcggcgtagaggttatccagcggaatgtcgaagaagccctggatctggcccgagtgcaggtccagcgtcaccacgcggtcggcgccggcggtggtgatcagattggccaccagcttggccgagatgggcgagcggggcgaggacttgcgatcctggcgggcatagccgaaataggggatcaccgccgtgatgcgccgggccgagccgcgccgcagcgcgtccagggtgaccagcagctccatcaggttgtcgttggcgggatagctggtggactggatgacgaagacatcctcgccacgaacgttctcgtggatctcgacgaagacctcgttgtccgagaaccggcggatcaccgccttggtgatggacatggtgagatattcggcgatcgcttccgcgaggggccggttgctgttgcaggcgaggattttcatgatggataccgccgggttagcgcgccgctgcgctccgtgaaaccggcacccgtataacagccggatacccgctctgtaaactggtgcctatgaccggccccttatttctgaggtatggcggctatgatgtccgcgataccctcggccccgccggcggcgatatcgccggccagagcgccccagggaccgctcagccggcccttgggcagggcaccctgctgggcggccttgcccagttccttgccggtcctggcgtcctgcaccacccaggtgacgtcgaggatctcctcgcccggacggccgggcaccagggtgatccggcccaacaccgtcacgtcggcttccggaccgcccagcctgagtcccaagcgccgcagggcttggcccagggcccgggacaaggcgctgtcgccatcgcccggcagcccggccaggggttccaggcggattgccggcacccgcgccggggcggaatcgagcggctgttcgggctcgccgtgcagggtcgcggcatatttcgccaccacttcgtcggccatgcggtcgatggtggccggacccgccgtctcccacagggcggctggcagggactgggtgatcgcggccgggatgtcgccgtccggggggatcaggcgccagaccagccgtttggtggcgatggaggtttccggcgtggcggccagcacccaagagccggcggcggcgctgcggctggaggcggggatgtcctgctcgctcaggcgcttgatgatggccttggccagggcggcgccgctggggctgtcatcgggcgggcgcaccaccacgccgcgcggcccgggtggcgataccgccgcgttgagaccttcgtgccggaagggctggggaatgtcgccgcaggcggttgtcagcagcagaagaagcagaagggaaaggcgtctcatcgatccagcgtgatcaccgagatctggcgtccgtaatcggcctcgccgcgcaaggtggcgcggcgatagctgaagaagcgagcctcgtcgcgcagggtgtcggcgggaacgcgggtgacctcgtgcacgcccagcttggccagtttgcgcgagatatagccgggcaggtcgaacaggaagtgaccgggccgggccggcgacggcgcgaagtaatcggcgttggtggggtcctcggccaggaagggggcggggaattccggccccacctcgtaattgcggtgcccgatgcacggccccatggcggcgacgatcttgggcatcttggcgcccatctccaccatggccttgatggtattgtccagcacgccccccagggcgcccttccagccggcatgggcggcggcgacgatgccggccttgccgtcggccagcagcaccggggcgcaatctgcggtcaggatgcccagtgcgatgccgggccggtcggtgaccatggcgtcggccttgggggccttggccgcgtcccagggctcggtgaccttcaccacgtcgctggaatgggtctggtaaagggtgaccagcgcttcttccggcaggtcgagcatggccatgacccggcggcggttttccttcaccgcctccggcttgtcgctggagcccggtccgcaattgagcgaggcgtaaaggccttccgacacgccgccttcgcgagtgaagaaaccgtggcggatgcgaacaaactcgttgagggccgacaaggtgatcatttaatcgtgttccaggccgggggggacgggcagcagaggggcggcgagcgccaggaccttgaacagggtgcccatttccccgggatcgatcaagcgccgtgcgccgctggccagatgggcggcctgctcgggcgtggcgttctgcatcagcatgcggacccgttcctccaggcccaggcgggcgaggaagctgccctggggcaccggcccatgggcgcgggccagcccggaggccgcctcggccagggcctggaagtccacatgggcggtgatgtcggcggtccccggcccggacagcaccgggtggcgcttgtggctcttcagcgcctggagcgagtcgccggcggcgctcttgccatagccgtaatcgatgatcagagcggctccgccctgatgggccagccgccgggcgatggtcccggccagggcgcggccctggggacagagttccgccacggcgccgtcggccgcgcccagcacggcgggggccaggggcggctcggccacgacagggccctgggcgaaggcgaaggcgccggcctcgtccagcgccaccacccgttcacgccagacgcctccggccttttccaactggcgaatgggcagggcgtcgaacagctcgttggccaccagcagcagcgggccgtcgggcagatcctcgaaccgctcgtgccactcgaccgaacggtcggtcagggcctgggcctgacgattgcgcaaggatgggctggtctcgatcaggtggacgttcagggccagggcgaagggaggcagggcctgcgcggcacgcagcagatcggccatcagggtgccgcgtcccggcccgatctcggccagcaccacccgtttgggtgcgcccatgctctgccagaccagggcgcaccacaggccgatcagctcgccgaacatctggctgatttccggcgccgtgatgaagtcgcccgccatgccgaacgggtcgcggcccatgtaatagccgtattccggatggcccaaggcctcggccatgaactcggacaccggaatgggaccggtggcgcggatgcggtcggcgaggatgtcggccagggtcattgtttcagcccctcaagcgccgggcgcgcgcctccgtgcgcttggctcctccgcttcccttctccgctgcgctccgtcgtcgcttcggggcgctcaacgcgcccgcgctccctccggtcgctcatgccgccttcgcgccgcgccgcaatgcccaggccagcagggcgaggccgaccagcacctgggggatggacagcagctggcccatggtggcaccgccccacaggaagcccagatgggcgtcgggctggcggaagaattccgaggcgatgcgggccagcccatagccggccaggaagacgcccgacagggcgccggcccgatggcggatgccggtcaggcgccacaggccgaacaggaccaggaacagcaccgcgccttccagtccggcttcatagagttggctgggatggcggggcagcgggccgccgccgggaaagaccatggcccagtccacgtcgggggcgacgcggccgaacagctcgccgttgacgaaattggcgatgcggccgaagaacaggccgatggggacggcgcagcagatgacgtcacccacctggaacaggttgcggccgcgaaagcgggaaaaggcgatgatgccgacgatcacccccagggcgccgccgtggaacgacatgccgccctgccagaccatgggaatctccagcggattttccaggtagtagagcggcttgtagaacagcacatagcccaggcgtccacccagcaccacgcccatggtggcccagactaggaagtcgtccacttccagctcggtcatggcattgggcggtcgcgccaccaggaacttgacgtagcgccagcccagcatcagcccggcgatataggccagggcgtaccagcggatggcgatgggtccgatctgcagcgcgatggggtcgatatggggataggccagggcgaaggtcatcaccggtaggcatccccggaggcgaggtagcgcttcacgtactgctcgacgccgtcttccagcgaggtgaagggcttggaatagccggcgcggtgcagacgctccatcttggcctgggtgaagtactggtacttgtcgcggatctcgatgggggtgtcgcggaacttgatctgcggctcgcggcccacggcgcggtagacggcgttggccaggtcgaggaacgagcgcgccttgccggtgcccacgttgaacagcccgctgaccttggggttctccaccagccacatcaccacgtcgaccacgtcgccgatccagatgaaatcacgcagctggccgccatcggggtatttgggattgtgcgagcggaacagctggtaggcggcgttcttctcggcatggggatagacctgggccaccacgctctgctggccacccttgtgatactcgttggggccgtagacgttgaagaacttgaggcccgcccattgcggcggcttgcgcgagccggcccacaccttgcgcgccacccggcggtcgaacaggtgcttggaccagccataggcgttcaagggacgcagatgggccagatgctccatggagccgtcatcgtcgaagccttgggtgccgtcgccataggtggcggccgacgaggcgtagataaagcgcacgtcgtgcagcgcgcaccacttccaaagggccagggacagcgagaagttgttggcgaggatcttgtcggcgtcggtctcggtggtggccgagatggcccccatgtggatcaccacctccatgtgcttggcattggcttcgaggaaatcgaagatctgctcgggatggacgatgtcggccagttcgcgcttggcgatgttttgccacttggtgcccgagcgcaggcggtcgcaaaccaccagcttgcccgcccccttttcctcgagggccgccaggatgttggaaccgatgaagccggctccgccggtgacgaggatcatgaggctctccgccagtgggatcattccgcgactcttataggccgggacgtgcgggctcgcaagttaccgtctgatccgcatcttcatgcgctcgaccgcgtcgaccagcccggcgcggatgccgggctccatggccgagtgcccggcatcgggcaccatgcgaagctcgcagccgggccaggcccgggccaggtcggcggcggactggggcgggcagaccaagtcatagcgcccctggacgatgatggccggcagatggcggatacggtccatctcgtcgagaagctggttgggacgcatgaaaccctgatgggccatgtaatgggcctcgatgcgggccagggccagggtggaggggccatcggggtctccgccctcgtcgcggggcagcaggcgggcgcaggcctcctcgtagccgcaccagacgcgggcggcgggcatgtggacgtgggtgtcgggatgggtcagccgttccagataggccgccagcggccggacgcgctcggcctcgggcagatgggccatgaagcggcggtgggcttcggggaaaaaacggcccatgccgctcatgaaccactccacctcgtcggggcggaacaggaagatgccgcgcatgacgaagcccgtgcagcgcccgggatgggcttggccatatgccagggccaaggtgctgccccacgacccgccgaacagcagccagcgctccactcccaggtgatggcgcagcacctccaggtcggccaccagatgggcggtggtattggcctccaccgaggcatgagggcgcgaccgcccgcaaccgcgctggtcgaacagcgcgatgcgccagaacgaggggtcgaagaagcggcggtaggtcggcgccgtggacgctcccggcccgccgtggatgaacaccaccaccggcccgtcggggttgccggaaacctcccagtaaagttcatggccgtcgcccaccggcagggcgccggtggcgtggggttcgaacggcggaaacagctccatgggcgctcctgttgctcctggttcaatatggcatgtgcctgccctgtctgcgagtgcttgacgctgggtattcccccggcctaaacccgccctcatgaaagttgacgattttgacttcgatctgccgcgcgacctgatcgccgagcgccccgccgagccccgcgattcggcgcggctgctgcatgttccggcggcgggagggctggccgatctgggggtgcgcgacctgcccggcctgctgctgccgggcgacatcatggtgttcaacgacaccaaggtgattcccgcccgcctgctgggccgccggggtctggcgggggtcgagctgacgctgcaccagcgcaccggcctttcccaatggaaggccttcgcccgcccggccaagaagctgaagcccggcgaccgggtggacttcgccgaaggtttttccgccgtggtggcggaaaagggcgagatgggcgaggtgaccctcgacttcgaccgctcgggcgaggatctgatggtggcgctggagacccatggtcatctgccgctgccgccctatatccgccagggcaccgccgacgagcgggacaagggcgactaccagaccgttttcgcccgcgagaagggcgcggtggcggcgcccaccgccgggctgcacttcaccccggagctgctggccgccctggatgcgcggggcgtcaagcgcgtcaccgtgaccttgcacgtgggcgcgggcaccttcctgccggtcaaggtggacgataccgacgaccatcgcatgcaccaggagatcggggtggtgacgcccgagaccgccgccgccgtcaacgcggcccgcgccgccggagggcgggtggtggcggtgggcaccacctcggcccgcctgctggaaagcgccgccgatcccctgggcacgcttcaccccttcgacggggccaccgacatcttcatcacgcccggccatgtcttccggcaggtggatgtgctgctgaccaatttccacctgccgcgctcgaccctgttcatgctgatttcggcctttgccggcctggagcgcatgaaggcggcttacgagcatgccaaggcggcgggctaccgcttctactcctatggcgattgctgcctgctggaacggacacccatatgagcgagcaaatatgcgagcgcgggcgcgttgagcgccccggagcgacgacggagcgtcagcggaggagggaagcggaggtgagcccagcgaacggagagagcgcccggcgattgagggacaagaaatgaccgaattctctttcgagcttcttgccaccgacggcgctgcgcggcgcggccgcgtccataccgcccatggcgccatcgacacgccggccttcatgccggtgggcacggcggggacggtcaaggccatgctgcccgcctcggtggccgccaccggcgcccagatcgtgctgggcaacacctatcacctgatgctgcgccccggggccgagcgggtggcgcggctgggcggcctgcacaagttcatgaattggccggggccgatcctcaccgattccggcggcttccaggtgatgagcctggccaagctgcgcaagatggacgccgacggggtgaccttccagtcccaccacgatggctcgaagcaccggctgaccccggaaagctccatggaaattcagcgcctgctggacgccgacatcaccatggccttcgacgaatgcacgccctttcccgccaccttcgagcaggcgcaagagagcatgcttctgtccatgcgctgggcccgccgctccaaggaggccttcgtggcgcgggagggctacggcctgttcggcatcgtccagggcggcgtctatcccgacctgcgcgccgaatcggccaaggcgctgctggagatcggcttcgagggctatgccgtgggcggtctggcggtgggcgagggccaggaggccatgttcgccaccctggaggtgaccacgccgctgctgcccaccgacaagccccgctacctgatgggcgtggggcggccctccgatatcatcggcgcggtggggcgcggcgtcgacatgttcgactgcgtcatgcccacccgctcgggccgtaccgcccaggccttcacccggcgcggcacggtgaacctcaggaacgcccgccatcaggacgatccccgcccgctggaggaggggtgcccctgtccggcctgccgcgaccattcccgcgcctatctccaccatctgatccgctccgaggagatcctcgggccgatgctgctgacctggcacaacatccaggcctaccagaccctgaccgccggtttgcgcgccgccatcgccgaggggcgcttcgcccaattcgcggcggatgcggccgcactggaagagcagggggatattgcgccgctctaacctgtcatcccgagtggagcgagggatctccgttctgtcgcgatgatgccaaattggttcggttgtgccaggatgagatccctcgcaacggttcgggatgacaccgaaatgctcgaccatgccgagggcctgcccctcgatcttccgccggcggccgaagcggcgctgacggaagccggccgcctgtggcacgaggaggccgccgccgaggccaaggtgaaggaggccctggctctggcccccgaagccttggcgacgcgcatcggcgcctacaaattctatttctaccgccatcgtctggacgaggcgctgccccatgcccgctcctgcgtcgccttcgccctggcggcgctgggcctgggcgaggattggcgggaggtgcgtcccggcgacgcggcctttgtcggcagcgccgtcaccctggcgccgctgcccaagctgctgatgcagaccctgatcgccaccggctatgtcctggcccgcttgggccgcgtcgaggaggccgaggcgcatctctccaaggtgctggacctcgatcccggcgaccggctgggggcgggacgcatgctggcggtggtgcggcgcggcggggtggaggacgaggagccttgagcgcccatctggcctatctgctggcctgggtcgtcttcggcctgtcccacagcgccctggccgggcgcgatctggccggacggtggtcgcgcattgcatacaatgttatcgccatcgctgccttcctggcggtgggaggcgtcggcggctgggccttgggcgccgagccggtcttcgacctgcccttctgggcaaaggcgctgctgggcggcatccatctggccggttgggcggtgatgctgatctcggcgcgctattacgacctggggcggctggggggcctgagccagctccgccacccggaccgtcccgccgatgaagaattgcgccgggatggcccccatgcctgggtccgccatcccctctatgccggggccttcctgatcctgtggggggcggcgctgtcgccgctggggctggccacggcggtctggggcagtgtctacctgctggtcggcacttattgcgaggaacgccgcctgctggcccgctatggccaggactatgccgcctatcgcgccgaggtgccggcgttcattccgtggcgggggcgaggggcattgggctgccgcccaaacccgcctggaggcgatgcctccagacctctcttttgattgcagataaatggggggctgggctcagcgcttgatgttgcacgccttgtcggccgaggccagggcgtcggagaagcccgacagcgggaaggtggccgccacgtcgctgcccttggcggggctggcgtgcagaatggcttccttgccccgctgcagggtggcgatgatggccttatcggtcttgggatcggcggcccaggcacgctcgcccttggtgaacagcgaatgcttcagggcgcccacctgcagctccaccgacgaatccttcttgaaggtgtaggtggcgttgatgctgacctcgtcgttgctcttggagccggggcgatgggtgacgatgaggaaggtggagttcttgcctttctcgccgccggtgaccttggcggcggtggtggcgatgtagcagaccttggcgttgccctcggtgtaggtcaggctctcccactcgccgtatcttcccaggcgcttggcatcggcggcgaaagccgtgccggtcgaggcgagcagggcggcggcgatgacggcaagacggacgagcatgggcgcaattccttggtgaccactggactcttattacccggcatcgccgggcttgtgaatcgaaaagggcccgaccgcgaggtcgagcccttgccgatttcagtcgatcgcgccggttagggcaggatgatctccacgcggcggttctgcggctcgcgcacgccatcgggggtcgggaccatgggcgaggtcttgcccttggcgaccacgacgatctggctggccgggatgcccagctgctcgagctgcgccttgacggcggcgccgcgcttctcggacagggcctggttgtacttggcgctgcccgacaggtcggtatgggccgacaggtcgatgcgggcggcaccggcggtcttggcggcacctgcggcctgctgcaggacgcgggcggcttcgggggtgatctgcgccttgtcgaagtcgaagaacacgatgtagttcttctgcacctgggccggagcgcggggcgccggggcgggagccggagcagccaccgggacgggcgccggagccggagccgccttgggggcgttgaacttgtagacgaagccaagcatcagaccgtggtcacgatactcggaatcgatcttggcattgttcgacgcggccttcgactcgtaatccagggtcgagaaatagcggtactgggccttcagttcgacattgtcggtgaggtcatagcccacgccggcaaagccctgataggcgaactgccagtcgtcgccgctataggcgttggcgccgttcttcttgacggttccgttgtccaggcgggcggcgccgataccaaggccgacgaagggatgccacttggactggggcaggaactcgtagacgccgttgaacatgggcgccagggccgaggtatcgccgctgccggtggcgccgccaaccttggagacgccgctggagcgataggacagttcaccttccgcgcgccactggccgaacgcatagccgaccacgccctgggtcagccagcccacgtcggactcggacttgaggccggaaacgccggagccgctgttcttggaatcctgcaggagctgggcgccggcgtcgagaccgacataccactgggcctgtgcggccaccggggccagggcaccgacgacgacggccgcggcaaggagggacttgaggctgcgcatggttatgaaccttcccgtgggggtgcgatgcgttgtgaatctgcccccatatctacgctcgcccccggcatccggcaaggtaacggtgccgcgccgcagcatgttctccggcggctgttgccgaaaagcaacagtgttacgcggtgggggcttccggttcggcgggaggggcggactcggcttgggccttcaggcggcggaacgagcgcaggctgacgggaatcatgcccagatacaaggtccccagcagggacagggtcaaccatggctcggtgaccaggaaggcggcggccaggccgatgatcagcaggataggcagcacccagcgatggggaatgcgcaccttcttacccgagaaggtcgggatcttgctgaccatcaggaacgagacgcccatcaggaacaccgacaccaccatcggctggtcgaagaagccgccgccgaactggatggtgaagaccagcggcatcagcaccagccccgccgccgccggggctgggacgccggtgaagaaattataggcgtagggcggcaggtcgggctcgccgatcatggtgttgaatcgggcgaggcgcagggcgcagcataccgagaacagcagcaccatggcccagccataggctccggcgccctgcatggtccagaaatacagcaccatggccggcgccacgccgaagctgacgaaatcggagagcgagtccagctcggcgccgaacttcgacgtgccctgcaacaggcgggcgacccgtccgtccagcccgtccaggatggcggccagcacggtggacatcaccgcctccttccacatgccgtggacggcgaagcggatggcggtcaacccggcgcacagcgccagcagcgtcagaatgttggggatcagcttgttgatcgacaacccccggatgcggggcggacgcttggggcggaacatcagcggatttctccctggcgggcgccttccgtggaatccaggtcggccagaaccgtctcgccggcgatgatgctttgtcccaggctgaccaggggcgccacgccgtcgggcagatagacgtcgacgcgcgagccgaagcggatcagcccgaaacgctggccggcgcggacctgctggccgtccttcaggtcgcacttgatgcgccgggccaccaggccggcgatctgcacgaaggcgatctcgcggccatcggcgcggctcatgcgcacgctcatgcgctcgttgtcggcgctggccttgtccagggaggcgtcgaggaacttgcccggccggtacgagcacttgacgatggtgccgtccaccgggcagcggttgatgtggaccgagaacacgctcatgaacaccgaaatgcgcatgcggggcgcgtcccccatgtccagctcgggcggcggggcgaccatgccgaccatctgcaccacgccgtcggcggggctgatcaccaggccgtcgcgggtgggggtgacgcggtcgggatcgcggaagaaccaggcgcaccagcaggtgagcagggcgccggcccagcccagcggcccccagatctggcccagcagcagggcccccaaggcaaagagcccgacgaacggccagccctcgcggttgatggggaaccaaagatacttggtcaaggaaatctgctgcgcctgcaccgcttcacctctcaataacaccgccccttttggattttcatcccggtcggcgtcatgatactagtgtggaggaattgaagtttctaccatgaattttgtcgaggatcgggcggcgtctgtatgtccaagtcgaaggcgttttctttgggcggcatgagcctgccgctggatatcgacgcggttctcgaggaggccgaggcccagcctctggcgctcggcaccggtcccgtggcgttcgatttcggatttcgcttcgtccgcttcgccggccggctggaacaatcggcctcgggcgttcagctcaagctggtgggggaccttggtcccatgccgtactcggcggaatcgcccgccgcccggtccgggttggcccgcatcgttgatgccggcaattccgtgctgggcgccgggtcgttccgtctggcccaggggcggattctgctggggggggaactgggcgttcccatgccggtttcggcggtgggtctggtctcggcggtgacgcgcttcctggttccggccacgccctatatggagctgatctccatgtacatccggccgcccctggcgcccgcccgcccgggcgaaagcgccgtgcgccccgaatggcgcaagtccaagcgccgctgaggcaacgccctagagtgcgtcagctttaagctgaagcactctaagattctgtctgtacgaaaaagctccgttttttcagggctcaagcgccgctcgggcttaagagttcttcgactttccgattcagcttaagtgcgaagaactctatttcgccggaacgctgaacacctggccgggatagatgcggtcggggtccttgatgtggtcgcggttggcctcgaagatcaccgtataggccatgccctggccatagagccgccgggcgatgcgccaaagggaattgccctggagcacggtcacggtggaaccgcccttcagggtggtctcctcgcccctggtccacgaggcctcgacccgggcgagaaccttgcccttgtcgtccacctgatcggcgcgcagcagatgggtgcccttgcccggcggcaaggcggcgctcacccgccagttgccctcggcatcggcggaggcgcggcccagcaggccgttgtccaggtagagattgattctggcgccgttgggagcgcggccactgaccgtcatgcggcccttgtcgttgtggtcgatgatgtcgagggacaggccgctgggagcggcggcggcgttgggtccttgcaggatgcggctgcttccgtcgcgacccgatttgatggccagggcggtgccctggccgcgcggcggcacgaccagcaccacggtctcgcccgattcggacaggctgccatcgggattgacggccttcagccgcagctcgcgcgagccgggaggcagcgggccgggaggcagcaacacccattccccccgcccgtcggcggtgacctggcccaattcctgggtgccgtcgatgacggtgacccgggcgccgggcctggcgcggccggcgatgaccgcgtcgccgcctgcatcgatgcggacaacgtcgaaggacggctcgcccaattcggcaatggcggccctggtggcggggccgggcggcgggggaatctgcgcctccatgtccttcgtctcgtcacgctggttgagcatggcgagcacgatggcgatcacggcgacggcaagcccgatgagggcgacgagcttaggccggttcaacggctcctcgctgtgtggtggtggaggcggccgctaccctagcccttatttcccccagtgtcacgggcgcgaatccgtcgcttgcgcccgtttcatgggttttctcccggtcctacccgcccgtttcccctcccaacgagtaggattgagtcttgcgtttggcaccccgaatgctatcgtcccgcgtttgccgcgtggcggaattcacgggcaggcgagggtatggcttcgagcgaggggtaagaacgatgacgaccgcgaaaatcatctggaccaaggttgacgaggcgccggctctggcgacctattctttgctgcccatcgtccaggcctttaccggggcggctggagttgcggtcgagacccgcgacatctcgctggccggtcgcatcatcgccaatttccccgagaacctgaccccggcgcagcgcatcggcgacgaattggccgaactgggcgaactgacgctcaagcccgaagccaacatcatcaagctgcccaacgtcagcgcctcggtgccgcagctcaaggccgccatcaaggaattgcagtcccagggctacaagattcccgacttccccgaggaccccaagaccgatgccgagaaggaactcaaggcccgcttcggcaaggtcctgggctcggcggtgaatccggtgctgcgcgagggcaattccgaccgccgcgccgccgcgtcggtgaaggcgttcgcccgcaagaatccccacaagatgggggcctgggccgcttcgtcccagtcccatgtcgcccacatgaatgccggtgacttctacggcagcgagaagtcggtgaccgtcgccgccgccaccgacgtcaagatcgagttccacggcaaggatggctcgatccatgtgctgaaggccaagaccaagctcaaggccggcgaggtcatcgacgccgcggtgatgagcgccaaggctctgcgcgccttctacgccgagcagatcgccgacgccaagtcccagccgggcctgctgctgtcgctgcatctcaaggcgaccatgatgaaggtttcggaccccatcatgttcggccatgccgtcaccgtcttcttcaaggacgtgttcgagaagcacgccgccgccatcaaggacctgggcgtcaacgtcaacaacggcttcggcgacctgatcgccaagctggacaagctgcccgccgccaagaaggccgagatcgaggccgacatcaaggccgcctacgaggccggtccgcccctggccatggtcaattccgacaagggcatcaccaacctgcatgtgccgtccgacgtcatcgtcgacgcctccatgcccgccatgatccgtgattccggccgcatgtggggcaccgacggcaagctgcacgacaccaaggccatgatccccgaccgctgctacgcccgcatgtaccaggtggtcatcgacgactgcaagaagcacggcgccttcgatcccaagaccatgggcagcgtgccgaatgtgggcctgatggctcagaaggccgaggagtatggctcccatgacaagaccttcgagattgccgccgatggcgtggtccaggttgtggacgaatccggcgcagtgctgctggagcagaaggtcgaggccggcgatatcttccgcgcctgccagaccaaggacgcccccatccaggattgggtgaagctggccgtgacccgcgcccggctgtccaataccccggccatcttctggctggacaagaaccgcgcccacgatgcccagatcatcgccaaggtggaaaagtacctcaaggaccacgacaccaccggcctggacatcaccatcaaggcgccggaagaggccatcgccgtctcgctggagcgcatccgcaagggtctggacaccatctcggtgaccggcaacgtgctgcgcgactacctgaccgacctgttccccatcctggaactgggcacttcggccaagatgctgtccatcgtcccgctgatggcgggcggcggcctgttcgagaccggtgccggcggctcggctcccaagcacgtgcagcagttccaggaggagggctacctccgctgggacagcctgggcgaattcctggcgctgggcgtgtcgctggagcatctggcccagaccttcaagaaccccaaggcgcaggttctggccgacaccttggatcaggctaacgcccggatcctcgacaacaaccgctcgccggcccgcaaggtgggcgaactggacaatcgcggcagccatttctatctggcgctctactgggctcaggccctggccgagcagaccaaggacaaggagctggccgcccgcttcgctccgctggccaaggcgctgaccgagaacgaggacaagatcaacgccgagctgatcgcggcgcagggcaagccggtggacatgggcggctactacagccccaatgattccaagacctcggccgccatgcgtcccagcgccaccttgaacgcggccctggccgccatttaatacggttcggcggcggcgggagatgcgaactcccgccgctccgttccggtccgccatctagagacaagcagatattgggcctttcgcaccccgaggaaccccgtcaatgaacaagatcaaagtcgcaaacccgatcgtcgagctggacggcgacgagatgacccggatcatctggaagttcatcaaggacaagctgatcctgccctacctggatgtggatctgaaatactacgatctgggcatcgagtatcgcgacaagaccgacgacaaggtgacgatcgaagcctcggaagccatcaagaagtatggcgtgggcgtcaaatgcgccaccatcacccccgacgaggcgcgggtgaaggaattcaacctcaagaagatgtggaagtcgcccaacggcaccatccgcaacattctcgacggcaccgtgttccgcgagccgatcatctgcaagaacgtgccgcgtctggtgcccggctggaccaagcccatcgtcatcggccgccacgccttcggtgaccagtacaaggccaccgacttcaccgtccccggcccgggcaagctgaccatcaagttcgtcggcaccaacggcgagaccatcgagcacgaagtgttcgacttccccggcgccggcgtggccatgggtatgtacaacctggacgagtccatctacggcttcgcccgggcttgcctgaactatggccagcagaagaagtggccggtctacctgtcgaccaagaacaccattctcaaggcctatgatggccgcttcaaggacatcttccaggaagtctacgagaaggaattcaaggccgaatacgcaaagctgggcatcacctacgagcaccgcctgatcgacgacatggtcgcttcggcgctgaaatggtcgggtgaattcgtctgggcctgcaagaactacgacggcgacgtgcagtccgacacagtggcccagggcttcggctcgctgggcctgatgacctcggtgctgatgagccccgacggcaaggtggtcgaggccgaggccgcccacggcacggtgacccgtcactaccgcgagcaccagaagggcaaggagacctcgaccaaccccatcgcgtcgatcttcgcctggacgcggggcctgttctaccgcgcccagttcgacaacacccccgaggtggccaagttcgcccaggctcttgaggaagtgtgcgtcgagacggtggaatccggcttcatgaccaaggacctggccatcctgatcggccccggccagtcgtggctgaccacccagcagttcctggacaagctggacgagaacctgaagaagcggatgggcctggcggcgtaatgccggactgacgttcggtcaaaaagaaccccgccggcggcccaggccaccggcggggattttttttggccggatcagcgggcgcagaacgaatcgatgcgccgacgcatttcctcctgggcgcgactcaactcctggaggctgtcgttgatccgggccatggtggcgccgaaaccggcgcggaaattgttgatatcgaatctcatgcttccgcacacccctgagttggatcgaccccctactggggtcatgcgcgaagtatgacaaaggaatggcaatacatttcgcgttggctgttaactcaatttaaaccaacttgaaatgtgtcgtcacttctcgattcggtagtaggttcttacccgtaactctgcaccagggagcctacgaccagataccagccatctaccataacgaagaagatcagcttgaacggcagggagatcatggcgggcggaatcatcatcatgcccatgctcatcagcaccgaggcgatgaccatgtcgatgatcaggaacggcaggaagatcagaaagccgatttcgaaggcgcggcgcagctcgctgatcatgaaggcggggatcaaggcccgcaggggggcgtcctcggccttctccacctccttggcgcgcgacagatccatgaacagcttgagatcctggccgcgcacatgcttgctcatgaaggcgtggaacggcttgacggcgcgctcgaagccctcgatctcgtccagatggccgtccatcaccggtgcgatgccgtcggtccaggccttctcgaaggtgggagccatcacgaaggcggtcagaaacatggccaggctgaccatcaccgtattgggcgggctctgctgggtgcccagagcctgacgcaggaagcccagcaccaccacgaagcgggtgaacgatgtgaccatcaccaggatggagggcgccaccgacagcacggtggtcagcgcgatcagctgaatgatgcgcgacgtggcgctggcctgcggtccgcccagatcgatgttcagggactgggccagaaccggtccggccgccagggcggtcaggatgccaacggcggcggccaggatcatccggcggcgggaagcaaggcgggtcatgttccggtctccggctcggttgggtccgaccagtcggcttccgggccggacagggtgaaggcggcgcgcgggcaatcggtctccaccaccgcaggctgggcaccgcccaggaccagcagatgctcgcggtcgtcgcggcggatcaggaccagacgatgtttcacgtccagcgtcaaggattccaccacggccagccggcggccggcggcgccgggacgtctggccaccatgcccggcaggcggctccgcaccacccacagcacgccgaagatcagtcccagcaccgccaccagcgacaggatgaaacgcaggtaatgggctgaatccatgctcaggcgtccagggaggtcgggttgttgcgctgggtcagcgcggcggccagcaggtcgagatcggccaccagggcctcgaggccggggcggaaggccacgccctcggagcgctccaggccgagcacggcgccgcagacgtggcggacccggccttccagggcggcaagatccacttcggtgccggtggccagcaggcgccgggcggtgcccaccagggtggaggccttttccagttcctggcgcagcgcgtcggattcggtgctcatgcggcgcctccggggggcggggccgcgcccatggcgccattggcgcgatagacataggccaggatctcggccacggcgacgaaggcctcgaccggaatgacggtgtcgacctcgacggcggccaggacctcggccagatcgggatcggtgcggaccttcaccccatgggcgaaggccaactgcagaatctgttcggccaccgcgccccgtcccgaggcggtgacggtgggcaggccgggatggtcggggtcgtcggccagggccacggccacctgacggcgcctgggggcggcggcggccttggcccgctcgctctccgcctcctcgtcccaaatgtccctatcgcccatggccggctttccaagcgggttcaccagggctcacaatggcctgggcgcgcttaaaattcgtttaagcccaggaattgggcatcgggccaaacccgcagggtgccccggctttactgaatcttaaacggcatgggtggatagtgatcatggcgagacgggtccgctcgcccacctgtaccccggcgaaggttcgcgtccatgtacgacgatctcggcattttcaagatggccaaggcccagatggactggatcgcccagcgccaggaggtgctggccagcaacatcgccaatgccaatacgccgcgctacctgcccaaggacatcaagccgctcgacttcaaggaagtgctggccggcacggcccagcccgacgtgggtgccaccaccaccaacgccaagcatattgtgcccgaggtgacgcccagccccttcaaggcggtgacccagcgccggactttcgaatccactcccgacggcaacgccgtcatcctggaagagcagatagccaaggttggcgacgccaattccaagtacaacgccgccgccgcgctgttccagaagtaccagaagatgatcaagaccgcctcgggcagccgctaggcccgtaattccaagagcccgtaattccaagagatcgccatggacgaactcagcaaaagtacgcagacagccatttcgggcatgaaggtgcagtcgcagcgtctgcgggtgatctcggagaatctcgccaatgccgattccctggcccagacccccgaggggctgccctatcgccgcaaggtgatgaccttcaagaacgagctggaccgcgccaccggcaccaatgtggtcaaggtggacaaggtgcgggccgattccgccgagttccagcgccgctacgaccccaagcatccggccgccgaccgcgacggctatgtgctggcccccaacgtcaatccgttgatcgagatgatggacatgcgcgaggcccagcgcagctatgaggccaacatgaacgtcatcaacgcttcccgctcgctgctgtcgcgcaccatcgagatgttgcgctaggccagatgccgcgttaaggatccatcatcatgacttcccgcctcaccgacgccatctccgcctataagaccgccgccaatcccttcgaatcggtgggcaagacctccgagaccgaaggcaacggcaccgacttcgcctccgtgctgaaggatgcggccaaggtggcggtgggtgacgccaagacggcagaaaaagcctccatgtcggccattgccggcaaggccgacatccgcgaagtggtggccgccgtcgccaatgcggaaatgaccctggaaaccgtggtcaatgtccgcgacaaggtgatcaacgcctataacgaaatcctgcgcatgcccatctgatcgggtccggcccagatgaccgagcccgagttgatcgacatcgcccgcgaaaccatcatggtcatgctgaaggtggcggcgcccaccctgctgaccggtctggtggtgggtctggtcatttccattttccagactctgacccagattcaggagcagacgctgaccttcgtgccgaagatgctcttggtcttcgcctccatgatcctgttcctacccttcatgctgcattcgctgaccgagttctggagactggtcatggaccgcgtcgtcgccggcggcggttaacgtgctgaccgatctgctccagctcgacatcttccggttcttcctggtgtttacacgcatcggcgccgccctgatgctgtttcccggcctgggcggctcgctggtctcgacccgcatccgcctattgctggccttgtcggtggccttcgtcatgctgcccgtggtgggcgccagctttccggcggtgccccgcagcgtcggcggcatgctgctggcggtgttcggcgaggcggtggtgggagtctatctcggcacggtgatcatgttcatcatgtcgacgctcaacatggccggctccatgatcggctatcagacgggcctgaccaacgccttctccttcgaccccatcgcgcagcagcagagccagcttcttaccggcttcctggctaatatcgggctggtggcggtgttcgccaccgatatgcatcacctgatgttccaggcggtattcgaatcctattatctgttcccgccgggccagccgctacagttcggagactatgccgagacgctaggccatctggctaccgacaccttcaaggtgggaacccagttcgcggcaccgctggtggtgttcggcctagtgttctacactggcctcggcctgctgtcgcggctggtgccccagttgcaggtgttcttcgtcggtatgccggtgcaggtgatggtggggatgtggctgttcatggtgacgatgccgctggtgatctcgctgttcctgcgcttcttcgaatccggcctgatgccctacgtccagccgaggtaagagcatggccgaagattccgacgacaaaacagaagaaccaacagaccgaaaactgagccaggcccgcgagcagggcaatatccccacctcccaggaggtgaagatctgggcgagcctggtgggggcgctggtggtggtcaccctgttcgccccttacatggcccgcgatatcgggcgcctgctgctgcccttcgtcgagcacccccatgccttccccatggggagggaggatgtgggccagttgctgtccggcatcacggtggacatgatcaagcttctgatcatgcccatgatgatgctggtggtgctggccatcgcctcggccatgggccagagcggcctgatgttcctgcccgacaagctgaccttggatttcggcaagctgagccccggcaagggccttcagcgcatcttctccggccgcaatctggtggagttcgtcaagtcgctgttcaaggtgtcggccatcggcttcgtcatctttctgatcctgaaatcgcatatgagcgaatatgccggcctggcggcgctggacctgatggcggtgctcgactatctgcgccatcaggtgatcaccatgatcattgtggtggtgctgatggtcttcgtgctggccgccgccgactggttctatcagcgctgggccttcacccagcagatgaagatgaccaagcaggagatcaaggacgagcacaagcagaccgaaggcgatcccatgatcaagggccgcctgcgcgccttgcgcatgcagcgcgcccgccagcgcatgatggccgccgtgccccgggccagcgtggtggtgaccaaccccacccattacgccgtggcattgcaatacgaccaggattccatgggggcgcccgtcctggtggccaagggcgtcgacctgatcgccaagcgcatccgcgacctggccaccgagaacgaagtgcccatcgtcgagaatccgcccctggcccgcgccctttacgccacggtcgagctggaccaggaaatcccgcccgagcactacaaaaccgtggcggaaattatcggttacgtcatgaagctgaagggtgaacttgcgcattaaatcccttcccgatccgctgtcgctctgcctggccgcctcggtggccgggaccgccatgctgggcgtggccgaggccggctggcccgccatctcggccgcggccctggtggcggcggtcgcggggagcatgctgtggcagcgctcgcgccggccggcgggcatcgcccccatcctggccggagccctggagtcggaaagccgcgccgtgctggtggtggcctcggatggggccgagctttaccgcaatcaggcggcgcgccgcctgctggggggggcggccgatcccctggccccgctcaaggcgctggccgccgccgatgatcgcgccctggccgagatggagcgcctggatgccgccgccgcggtaggggcgccccggcgcaccgaggtgaccctggtctccgccggcggtgggcgtgaatggctgaccctggaggtccgcccggcgggcagcccccaggcggtggcctggatcgccgaggatgtcagcgcgcggcgcgccatcgacgagacgctgcggcgcgagaacgaattgctgtccgatttcgtcgatctgctgccggtgggctgctattccgccgatgcggacggcacggtgcgctacgtcaaccagcgtctggccgaatggctgggcaaggccggcgacgagattctgggccgcaatctggccgaggtgttcggcatcgttcccaatcccgaggaagaacgggccgagttgcgcctgcgcggccgctcgggcgaggtgttccaggccctggtcgcccattcggtgttcgacgaggggggcgagatgttcacccgctcggtggtggtgcgcgatctggtgccggaacagcaatgggaaaaggcgctgcgcgccgccgagcgccgcttccgctggctgttcgacgacgcccccgtcggcatcgccctggtggatctggacggggcggtgggagcctgcaatcttgccctgcaggccatgctgggcatcgaccgcgacgacatgatcggccgcccggtgatcgacgtggtcgccgaggagaaccgccccgcggcctccgagcaactgggcaaggtgattgccggctccacccccggcacccatctggaagtgcgtctcaaggggcggcgcaacctcatcgcccagctcttcgtcagccccagccacgaagacggcgacatctccggcctcgtcatccacttcatcgatgccaccgagcagcgcaacctggaaatgcagttcgcccagagccagaaaatgcaggccatgggccagctggccggcggcgtggcccacgacttcaacaatctgctcaccgccatgatcggcttctgcgacctgctcttgcagcgccacggggccggcgatcccagcttcgccgacatcatgcaggtcaagcagaacgccaaccgcgccgcctcgctggtgcgccagttgctggccttctcgcgccgtcaggccttgcagccccgcctgctcaacgtcaccgacgccctggccgagctgtccaacctgctgcgccgcctgctgggcgagaccatcgagctgcgcatgatccacggccgcgccctggggctggtgcgcgtcgatcccggccagttcgatcaggtcatcatcaatctggcggtcaatgccagggacgccatgccgggcggcggggcgctgaccatccgcaccaatgccgtccacgtggaccagcccattcagcgcggccccgagctgatgcccgccggcgattacgtccagatcgaggtggccgataccggcaccggcatcggcaaggagaacctggcccgcatcttcgaacccttcttctccaccaaggaagtgggcgccggcaccggattgggcctgtccaccgtctacggcatcgtgcgccagaccgacggcttcatcttcgtggagtcggaacccggccagggcgccactttctccatctacctgccgcgcatcgacgccgacccggccgccgagaccaaacgtgcccccctgccatcggaagccgccggtgccgaccttaccggctcgggcaccatcctgctggtcgaggacgaggacgccgtccgcctgttcggcgcccgggcgctgaggaacaagggctataccgtcatcgaggcccgctcgggcgagcaggccatggaagtcctcaacggcggcgagcccatccaggtgctgatctccgacgtggtgatgcccggcatggacggcgtgaccctggcccgcttcgtgcgcatggagcgccccgccatcaaggtcatcctcatctccggctattccgaagacgtcgcccgcgacggcatcgaccccgacgccggtatccacttcctccccaagcccttctccctccggcagctggcgggggcggtcaagcaggtgatggacgaagggtaatgggccgcccaagcgcaggggcgcccgcgcccccgcacccccaggccaggggcaaaggcccctggaccccggtcctttaaacaacgaggaagaacggcgtcagcatttctatcttttgatgctcgcctgaggtgggctccctatgcgccaatatgggcaatagagccaatcgaattgtcgcccgggtagcccgagtttagaagaaattcataccctgaatcgtagtatggcggcggaaatagagcgtgaactccgagcatttcgccggagccaagccaagaaatagcgtcggacagcttgattcggattatcccgcggatttgcgcggcatagtcgcttgggcgaataatattctttccccgcagccgaaaaagaacgccatgttgcgcgtgcgggcgtagaaaaatagatggagatgcaactcgcagatcgacgaactcagtttccgagccagtgaggatgcctggcgaaattggctgatctgcgtcaaccgcaatcattagaatataggcgtatccatcaggctccttgtcctgccctctcttctcaaaatgcagaaatttcccaattttgtcggctgatcgaactttgtggcaagcaaaccatagagcgacccaaacgttatcaactaagtctatccatgatgtttttagtccgtaatgctgtaccaaagcttctttgcatttttcatgcaatgtgttgaatgtttttgctttagatgaaatgtgtgaaatggcgtggcttaattttcttaacctattcgacagcgatctgtgggagattgtccccctgaacagcgaaggcgatagtgtgctgtagagctccgtctgtccgcggaaataaatgcgctcatttagttttgagtttttaaattttaaattttaaatacccagcagcctgaatgagggcatgtggatcattcacatgaagtacatcctgtccggacgcagcatcgttaatgtaggtagaatttcgagtgtatattttgctgaacgacaaattatattcaccctgcatgtggttgttgcgctgctaatgggtgcaaaaactgtacattttgcgcgaattgaggacaatctgaattttgctgccactgaagatgaaataacgaccaaggatgcgcgaagggacgagtcccttcgcacccttcctccccttccgactaccactccgacagcacccggctttcatccccgatcagttcggggtattggctgcggcccagtttggcggcttcggcggggacctgctgcagcaggtagctttccagggcgccgatggtgatggcgcggccgccgttggcggcgttgccttccaggcctttcatcaggtagtagctgaacaggccgtggcgggtggcggcgaggctgctggacagctggtcgcggccggcggcggccaggatggtgacgttggggggcaggtcgctttccttgaccgagatgaggatggggcgggcggcctggaccagggtgtcgttgccgcgggtgccgccggaatagcaggtgtcgaggaacagggtgacggtgcgggcgccggcggcgaccagggcgtcgatgatgtccttgcgcttcagcgcgctttgggccagcagcatgcggtcgccgtcatagggcagcaggtactggtcgcgtccgtcgtcggaggcgaggccatggccggagaagaacaggtagacgtccgacttgccttgggcgatcaggggctggacccaggccagcacggccttctccacggacaggcggcgggccttgtccccggtcagcagcttgacccggtcatggggcacgcccatggcccgggtggcgtagtcgtagaaggcgttggcgtcgttctcggcgaattcggcgcggggggcggattcgtagcggtcgacgccgatgaccagcgccacggccttggggttgcgcttgcccttggcgcggccgggattgagcggctcgtaggcggaggcgccggcgggcgggggatcgcgggtgacggtgaccatggcttcggtggcgcgtccctggcggtcgcgggcttccaccttgatctcggtctcacccaggggcacgccccggcgatagcggaacgagccgtccttgccgagcttcacctgggcgccgtccacgaacacggtggagcccttggtggtgccggtcaccttgccggccagttccacctccagatcggtggtctgcaggctatcgggcacctccaggcggacggcgctggggacggggggctgcggcgcggtgggcttggggccgggcaggggcggcggcggtgcgatggaggccagggtgggcctggtgccgcgaaggtccagccccagggtggcgaagatggcttgatcgctgaggccctgacggcgcgatcgggtgacgaagcgctcgatgcgggggtggcgctccaggatggcggccagctcggcatcgctgtagcccctctggcgggcggtggcgatccattccttcagccagggcggcgggatgaatttggtggggtcgtcggattcgtcgtcgacgcggtcgcgataggcgccggccggcgggagatagggcggtggcggcggtgccagccgttctccccgcaagggcggtaggggcggcggcggtggaggggggcggaagccgtcccgccgctcgccctcgaagtctcgcccggcgaagtcccgcccgccgaagcctccgcggccgaaatcgtgcccgccgcccggcccgccatcgcggccgccgcgcacgggtaggacatgggcgcggcccgggatgtcgggggccgtgccggccggcggcgtggccccccggctgatctgggggatgaacagcagcatcgcggcggatgccaccatggcggacagagcgagacgcatgtttccggccccttctggacacgaacgccgttcagtctacgccccttttccttacttaaatgtggagccgctcacgcggatggtgtggaactgaaatggaacaaacgcgaacattccgcttgtgttcctctaaagttcgtgtagcttaatcctcattgcggaaccgcccggttcgggatagatgaaggggaacggccatgtctcaggctgcattgcgtctcgtggacaaggataccatggatagacagaaggctttggaagccgccgtcagccagatcgagcgggcgttcggcaagggctccatcatgaagttggggggcaaggaccaggtggtcgagaccgaggtggtctccaccgggtcgctgggcctcgacgtggccctcggcatcggcggcgttccccgcggccgcatcatcgaggtctatggcccggaaagctcgggcaagaccaccctggcgctgcacatcatcgccgaggctcagaagaaaggcggcacctgcgccttcgtcgacgccgagcatgcgttggacccctcctacgcccgcaagctgggcgtcaatctggacgagttgctgatcagccagcccgatgccggcgaacaggctctggaaatcgccgatacgctggtgcggtccggcgccgtcgacgtgctggtggtggattccgtcgccgccctggtgccgcgcgccgagctggaaggcgaaatgggcgacaaccatatgggcctgcatgcccgcctgatgagccaggcgctgcgcaagctcaccggttcggtgtccaagtccaagaccatcgtcatcttcatcaatcagatccgcatgaagatcggcgtgatgttcggcaatcccgaaaccaccaccggcggcaacgcgctgaagttctacgcttcggtgcgcatggagatccgccgggtcggcgccatcaaggaccgcgacgaggtggtgggcaaccagacccgcgtcaaggtggtgaagaacaagctcgccccgccgttcaaggtggtggatttcgacatcatgtatggcgaaggcatctccaagatgggcgaactgatcgatctgggcgtcaaggccaatgtggtggaaaagtcgggggcgtggttctcctacaactccacccgcatcggccaggggcgcgagaacgccaagaccttcctgcgtgaaaacccggccatggccgccgagatcgaaggcgccatccgccagaacgccggcctcatttccgaggccctggccggcggccccggcgatctggacggcaccccggtcgaggaatagccggtactatcgggcacagcccgaagcgaagggccatccgcgaacaggcggatggccttttccgtttccggcggcggatgccccggcattggggtgggatgttccctacccctcatgggtggtcagcccaattcgcatataacaagtcagcaagcctgtcctaatatgttgcaacgcagcaaacgaagaggagctgaccatgtatgaactgaccctggccgtaatggccctgatgaagctggttcccaagcttttggaaaaggagaagcccggccaggcctctctgatctaaaacacacaccttcggcccaccctcttggacggcctgttcctgccaagggggtgccgactggccctccccctaccacacattgccgggaaaccgctggagacaatttggtgggctgaaacaccctatcacggtatagtcgccgaatgggaacatatggtgatcatatggcggcggtgtgccgggattgcggcgcccttggcgtcggggaggcccccttgtgcccggcctgcggctcctcccgccgggtgcgtcatcccgagctggccgatctgaccatcgcccatatcgattgcgatgccttttacgcttcggtggagaagcgggacaatccggccctggccgacaagccggtgatcgtcggccatcccggcgggcgcggcgtggtaaccaccgcctgctacgtggcccgcaagttcggcccccgctcggccatgcccatgttcaaggcgctggaactgtgtccccacgccgtggtcattccccccaatatcgccaaatacaagcaggtcagcgcccagatccgcgccctgttcgagaaggccacccccctggtcgagcccctgtccctggacgaggcctatctcgatctgtcgccgggggtgcggctggtggaccggccggcggcggtgctgctggcccggctggcccgcgccattcggctgcaggtgggaatcacggtctcggtgggcctcagctacaacaagttcctggccaagatggcctcggacctgaacaagccggagggcttctcggtgatcggccgcgaggaggcggaggcgtttctggcgccccgtccggtgaccgccctgttcggcatcggggcggcgacggcggcgcgcatggccgatcagggcattaccaccatcgcccagcttcaagctttgccggaaaccgagttcgtggcgcgttggggcaagttcggccggcgcctagcggggatggtgcacggtatcgaccatcggccggtcaatcccgaccgcccggccaagagtgtttccaccgaaaccaccttcgcccgcgacattcgtgacgccaaggccctgaccgaggcgctgccgcccctggccgagggtgtcgcccgcaggctggagcgggtaaatctggcggggcgcaccgtggtactgaagctcaagaccgccgatttcaaggtgatcacccgccacctcaggctacccgaccccaccggcagggccgagactatcgtccgcgccgggcttgcgctgctggagcgccagatggacggccgggccttccgcctgctgggcatcggggtgaccgatctctgcccggccgaggaggccgacccgccggatctgttcggttagaagaagggctgccgcccaaaccccattcatgaaacaaaatggggtccgggggcattggccccggatgggtttgggcgatagcccaatcgatcgcgggaggccttaccgttgcggcgccggagactccaggaattcggtcaccgcctgatagagctgcttgcggttcttctcgatcagggccgcatgggtggcttcgccaaccatgacgtagcgcttgaagggcgagccggtcagccggttgaacagcttcatgcccatggcgggcggagcctcggcgtcccactcgccctgaattaccagggccgggaccgaaaggcgttcggggttccagcgcggcttggccgaagcccagaagcgcatggtgtccagcacgaccccgtttggcgcccggaccgtgttgggaacgaccggctcggcatcgctggcgatggtggccttcagccagtcggcgaacaccgccttggacagcacgccttcgcgcttggcctcgggcaccgccttcagccagatgtcgcgggcttcgcgggggtccacctgccgccacgcgggaacgcgggccagttccgcatcggtgggcggcgtcacgtcgcgcagccattgcggcgcatagagcaccaggcgctcgaccttgtcctgggacgaattggcataggcgccggccagggtggcgccccacgaccagcccaccagaacgatccgctgggaattgcgccgcgacaagatgaagtccacggcgcgggagacgtcgtccacggcctcggccgtgtccaccacggggggattggcttccggcggctggctcatctcgggcgggtgcccggacttgccatagccgcggatgtccaggctatagacgtcgtagcccttggcggccatccaatccatccagctctggccgtccacggccatgtcgaaggaggaatgggcggggtaggtggcaccgtgaaggaacagcacggtcttttccggccgcacgtcgtagagcgctgccggatgtttgttgcggatgtagaggttctgatcgggccatttgctggcgatcttgaattcctcggtcaccgtctcggccccggcgggcagcgcggcggccatcaacaccaaggccgcaatggccaccccccatccccgtcccagaatcgccatcatcacccatccactccgctcaagttcatgtcgcccccgaccccaccggcaggcgtaccgtcaccaccgtaccctcgccgggcgccgatgccaattccacccttccgccatggaggtcgacgaagcgctgcaccagggccaggccgatgccggaatcgtcgtcggcccggccggcgggcaaggcttcgcgccgcccgccggtggcaaagccgccgaacagccgctcgcgctgctcatccgaaaggccggtgccggtgtcgctgatggtcagcgccagttccgacggccgccgctcggcccgcacgctgacctttccccccgacggggtgcgcttcaaggcgttgcccagcaggttgaacagcacctggcgcagccggcgctcgtcggcgacgatccagccgatgtccaggggacagtcgaagtcaagggtgaccttcttttcccgcaccctctcgcgcaccagccccagcacgccggacagcatggggtggacgtcgacggtgtccagttccagggccatctgcccagcctcgatggcggcgagatcgaggatgtcggaaatcagcgcctgcagcccctgccccgcctcggtgatgccgcgggcgtattcgtgctggcgcttgttgagcttgccaaaatactcggcggccagcatttcggaaaagccgatcaccgtggttagcggctttctgacctcggccgagacattggcgatgaattcgctcttcagcaggtcggcggcggccagggcctcgttgcgctcgcgcagggcgcgctccacccgggcggaatcggtgacgtccagccaggtcagcagcatggcgccgtcgggcagcggcaccgaggcgaagtcgacgatggaatcgtccaggcgctcgacccggccgctttggggggcgcgggtgttgaacagggccatcaggcgctcgcgcatttcgggccacaccgaggcgcgttcggcgccgccttcgaaatagggccggtgggcctcgaccagttcgttgagatgcggctcggactccagcatggacggggccagattccagatccgggcataggccggattgaacaggcgcagccggccgtcacccttgaacaccgccacgccctcgtgcagatggtccagggtctcgcgctggaccgccagggcggtattgaacgaacgctccagagccagggtgtcggtgacgtcctcgtaggtgaagatcaggccgccatagggatgggcggcgatcatgcgccggagcgtgcggccgtcgggcaggtggagcagggtctcggcggcgtcgatcagcgagatgaagcgcttcagctcgtcttccttgtaggcgcggtaatcggcgacctcgggcagcagccgccgctcgcgcagggaatccagcacggcgccgtaggtgggctgggccgccagccactcggcctccaggcgccacagccgggtgaaggcggtgttgaagaaggtgaggcgggtgtcggtggaaaagatggcgatggcggtagccagatgctccagcacctgggcgtgggcgctggcatgacgggccagctcctgctgcagctcctcgacgcgggtgaggtcgagggcatagccggcggtcagcaggccgccatcctcggcctcgaagggggcctcggtgatctcggtgaagcggcgttggccgcccagcaccagatggaaggattctgaccggggctcgccggccgcccgggcgcgggccgccagggcgcgggcttcgcgcaccgagccgtccgaggccagctcgatctgtcccgccaccgccgccaggggcgaggccacgtccaccgcccgggcataggcccggttgacatgcagcagggacaggtcgtcgtcgcggacccaggcgggaatgggcaatacgcccagcaatccctcgatccgttcgcgctcgaccaccagcccggccaggcgcgaggccagctccgcctcgaaggctgccccttccgtgacgtcgtgcatccacaccagatcggccagggctgcgccctcggggccgcaggcgcgaacccccaccgcccggacgcggcgcccgccgtcccgcaggcgcaattccagctcgaatccctggccctcctcgcgcaggcgccgcgccgcgctgtccaactgggcggcatcggcggcggcgaaggattccagcacatccatgaaggcggattccgtgccgccgaacagacccagcagcacggccagacgccgcgagcagatctcgcgctcgcccagccaggcgtaaaagccgtcgggcgcggccagcaggctctcggtcaggcgatcggccaggatgacggcgcgaccggcatcggcggccagactcaccatgcgccagcgcagcagcgccagcacggccagggccgggaccaggaccagcagggcaccgatgcccagggacagggggtcgaagcgcagcgacgccagggccggcgcctcttcggccgccgctccgcccgccgccagcatcaacgccaatcccgccgcgaaagccgcgcgcattccatcatctccccataggggtcccaaagtgccgatgcgcggcgcaaaagacaaggggtggttgcccctttgccccgctgctgctacacctcgcccgttcctggggagtgagaatgatgctgaagggcctttacgactggatgatggccaaggcggcccaccgtcacgccatctggtggctggccgccatctcgttcatcgaaagctcgttcttccccattccgcccgacgtcatgctgattcccatggtgatcgccgcgcccacccgctggctgcgcatcgccatggtctgcaccgcgtcctcggtggcgggcggctatctcggctatgccatcggccacttcgccatggattccatcggcatggccatcctgggcgccttccatctgcaggaaaagttcctggccctgaagccgatcatcgatgaatggggcgtgtggttcatcatcgtcaagggcgccacccccattccctacaagctggtgaccatcaccgccggcgccttcgacttcgacctgatgaagttcaccttcgcctcggtggtggcgcgtggcatgcgcttcgtgctggtggcggcgctgctgtggaagttcggtccgcccgtgcgcgagttcgtcgagcggcgcctgaagctggtcaccacggtgttcgtcatcgtgctggtgggcggcttcttcatggtgaagctgctgtagggcagggcttatctaaaggttgataaacttcggactcggcaggcaaagcccttgctgatctcccttgcttgaattattctacttctcactctggcgctcctccccgctccccccactccgctgggatgggcgaccagggcccaccgctcaatctcagggagacgggtgggaagcaaagggctcagctcgcgccaccctccccccataaggggcgcgaagcggccacgggcggcgagggacggggccgggcaaccagccttccatccctcgccggcccataaatcccgtcagccctcttccttgtccttgcggcgatgaatgttcagtccgatttcgtccaggaaggcctgttccttcttgtcgcgttcggcctgggcgcggcgctcacgttccttttgggtgatttcgtaggtcttcagctcgttgaaggcctcggccagttcgtcgcgggccttgacgatttcgcggcgcacctgctccagcatctgcatcagctgctcgcgccgggccagccaggcattggcgaaggtggcataggcaaagcccacgcccacggcatcatcggacgccacccgttgctcctgaatcagggtctgctcggcgtggtggatggcggccaggatctcgtcctcgcggccctgcagcgccaccaggacccgctgcttctcgtccacgttccacttggacaggcggatgagggtcttgaggcccttgttggccattcaggacctacttccgccccatgccgtcgccgtcgaacggcatgcccagcacctcggccagctgggcgtagcaggtctgcagggtggtggcttcggtcttcagctggcccagaaaggcttcgatggccggatagtagtggatggcttcgtccaccttgggatcggtgccgcggcgataggcgcccaggcggatcagctcggccatgtcctcgtaggtggacagcagcgagcgggcgcggcgcaccagatcgttttcctgctgattgttgcagccgggcatggttcggctgaccgagcgcaggatgttgatggcgggatagcggccgcgttcggcgatggaacggtccagcacgatgtgtccgtccaggatgccgcgcaccgcgtcggcgatgggctcgttatggtcgtcggcgtccaccagcacggtgaacaggccggtgatggagcccttgcccacgccgggaccggcccgctccagcaggcgaggtaattcggcgaagacggtgggcgtatagcccttcgacgccggcggttcgcccgccgacagcgaaatctcgcgctgggccatggcgaagcgggtcaccgaatccatcatgcacagcacgtcgagaccctggtcgcggaagaattcggccacggtcagggtcatataggccgcctggcggcgcatcagcgggctttcgtccgaggtggagaccaccactaccgagcgcttcatgccctcggggcccaaatcgtcctcgatgaattcgcgggcttcgcggccgcgttcgccgatcaggcccagcaccgagatgtcggccgaggtgttgcgcgccatcatggacatcagcgacgacttacccacgcccgacccggcgaagatgcccatgcgctggccgcggcagcaggtgaggaaggcgttgaccgaacgcaggcccagatcgatcttgcccgacacccgcgagcgggaatgggccgaaggcggctgggccttgaccggataggcggtgtcgccgccgggcagggggccgagcccgtccaccggctcgccgaagccgttgatcacccggcccagccagccgcgatcgggaaagaccaccggctcggcatcctgcacctcggtgcggcagcccaggccgatgccctcgatgggggaatagggcatcagcagggcgcggccctgccgaaatcccaccacttcgcagatcacccggcggccgtcgcgggccaccacgttgcagcgatcacccacggaaatggtgcgctggacgccgccggcctccagcaacatgccctgaacggcagcaatctggccgtaaacctggatgttggagacccgttcgatgtcgctgatcaggttgcggaccaggaatttcaattgcaccgccccttccagccgccttgaactcgtcagaatacacccgtatggttaacacatcgtagagacggatgggaccggggaccttacgatgcgagtcttggtggtcgaagacgaccagttgatgtccagagcgatcgaatccatgctcaaagccgagggcatggtggtggataccactgctttgggcgaagacggcctggagatcggcaagctctacgattacgacatcatcctgctggacctgatgctgcccgacatggacggctatgaagtgctgcgccgcctgcgatcggcgcgcatcgacacgccggtgctcattctgtcgggcctgtccgaaccggacaagaagatcaagggcctgggctcgggggccgacgattacctgaccaagccgttcgacaagggcgaactggtggcccgcatccaggccatcgtgcggcgctccaaggggcatgcccagtcggtgatcgacaccggcaagctgtcggtgaacctggacgcccgcaccgtcgcggtgactggcgacccgctgcacctcaccgccaaggaatacggcatcctggaactgctcagcttgcgcaagggccagaccctgaccaaggaacagttcctaaaccacctctatggcggcatcgacgagcccgagctgaagatcatcgacgtcttcatctgcaagctcaggaagaagctggccaccgccaccggcggcgaatcctacatcgagacggtgtggggacgcggctatgtgctgcgcgaccccgacatgcccgccgtcaattccaacaaggccggcgcggcggagtgattcattgggcactcgcccaaccccatctgctcgcttcgctcgtcccttcaggaccgcaccttcggtgcgtcgtttgcccctgcggggctgcacggggccaatgccccggccccatttctatttataaatcaaagggaggtttggaggcatcgcctccaaccggggttacggggcgggagccccgcatcgccccctatttcagatacagcgccaccgccagaccggcggcgatgacccaggccagcaggggcgaggggcggcgcaggcggccctggtcggggaacatggccttgaccgtgtcggggtgcagcttgagcccctgattgaccagcatggaataggtcttctcggtctcggccagcaggcggggcaggcgctccagcgagccgaccacgctgctgaaggtttcgcgcacccgggcctcggggccgagattctcgcgcatccagccttcgatcagcggctgggccagatgccacatattgatgttggggtcgaggatgcgcccgacgccctcggccaccagcatgctcttttgcagcagcagcaattgcggctgggtttccatggcgaaggtctcggtgacctggaacagctggcccagcagcttggcgatggagatttcgtgcagcggacggcccaggatgggctcggcgatggagcgacaggcctgggtgaaggtgtccagggactggtcggcgggcacatagccggcggcgaagtgtacttcggccaccttgcggtaatcgcccgacaggaaacccagcagcatctcgcccaggaagcgccgcgtgcttttgtcgacacggcccatgatgccgaaatccatggcgatcagctgaccgcccttgccgatgaacaggttgcccggatgcatgtcggcgtggaagaagccgtcgcggaacacctggttgaacatggcttcggcggccttggccagcacgtcgacggggtcgatgcccgccgcccgcatgcggtccacctcgtccaccggaatgcccgagacccgttccagggtcaaaaggcgcttaccggtgcgcagccagtcgacttcgggcaccttgaaattgtcatcgccgcggaagttctcggccagttccgaggcggcggcggcctcgaagcggagatccatctccagggtgacggattcctcgaaggtcttgaccgtttccaccggcttgaggcggcgcagccggggaacggccagctccgcccactcggccagccagtacagcaggtcgatgtcgcggtggaacttggcctcgaccccggggcgcagcaccttgaccgccacttcgcggccttcgcgggtggtggcgaagtgcacttgggcgatagaggcggcggccacggggatgtcgtcgaaggcggaatagaaattggacagcggcccgcccagttcctcctcgatgatgcgccgggcatcctcgggcgggaaggggggcagcttgtcttgcagccccgacagatcggcggccatttcctcgcccagcaggtcggcgcgggtggacagggcctggcccagcttgatgaaggacggtcccagctcggccagggcggcggcgaggcgctcgcccggccgccccgaactggccggacggcggccgccgcgcagcagcttcgagccgaagcgcgcgatgggcagatagtcttccagcaggaacaaggcgtcgtggcgagccaggacgcggccgatggtcagcaggcggttgaggttgcgaaacgacctgatcatggcgacaggccttcgacctgtcttgcattgtcatcccgagcgatagcgagggatctccgcttggactgccgggtccgattcggaaccgccggatcaggacgagatccctcctcccgatggtcgtcgggatgacggttcgcctcaccgggcgccatcatatccgccaccccgaatggatggcggcgatgcccgccgacaggttgcggacctcgacgcgggagaagccggcggcctcgaccatggctgccatttcctcctggggcgggaacttgcggatgctttccaccagatactgataggcctcggcattgccggtgaccatgccgcccaccttgggcagcacgttgaaggaataggcgtcataggcctcgcgcaggcccggcacgatgacgcgggagaattccaggcacatgaagcgcccgccgggacgcagcacccgataggcctcggcgatggccttgtcccaatgggtgacgttgcgcaggcagaaggcgatggtgtagcggtcgaccgaccggtcgggtatgggcaagtcctcggcattgccgcacacccaggtcaggccgcccaccagattgcggtccacggcgcggtcgcggccgacggacagcatctcgcggttgatgtcgcagacggtgacggggccgccaccgcgctttcgccagccgaaggcgatgtcgccggtgccgccgcccacgtccagcagggtctggtcgggccggggccgcagcatgtcgaggaacgccgacttccacaggcggtgcacgccggcgctcatcagatcgttcatcaggtcgtatttggacgccaccgaatcgaagacgccgcggacgagggaaaccttctcgtcctcggccacggtcttgaagccgaaatgggtggtgccgtcgttatgagagtggctgtcggtcatggggcggcaccttatcgcggaaattcgtcgctgtcacggggcggagcctgccttatactccccgccatgcctgaattgcccgaagtcgaaaccgtcgcccgtggtctggcccaagtgtgggacgggcggcgctttgtctcggtcgagacgcggcgtgccggactgcgcgtgccgttccccaaggatttcgcccggcgcctgaccggccggacggtggaggcggtggggcgccgggccaagtatctggtggtgcgcctcgacggaggcctggtcatgctgggtcatctcggcatgtcggggcgcatgaccatcggcgccctgcgcaacgagccgcccggtccccacgaccatgtggagtgggtgacggaccaggggatcagcgtgacgctcaccgatccccgccgtttcgggctgttcgccctgtgcgaggcgtcggacctgggcggtcatccgctgctggccgggatcgggccagagcctctggacgaagccttcgacgccggcgtcctggccaaggccctggccggcaagaccggccccatcaagacggtgctgctggaccagaaggtggtggcggggctgggcaacatctatgtgtgcgaaagcctgttccgggcggagatctcgccgctgcgccccgccggctccctgagccgggccgaggtggggcgtctggtgccgctgatcaaggcggtgctgagcgaagctgtggcggcgggcggctccacccttcgcgaccacgcccggcccgacggcgagctgggctatttccagcattcctttcaggtctatgggcgcgagggcgagacctgccccggctgccccggggcgccggcctgcggcggcatcttgcgcatgacccaggcgggtcgctccactttctattgtgcgaagcggcaaaggtgatggtataggcattccatggctcgttttcggcatctgcttaccgctttcgcgcttttcctcctgctgggctccggatcggcgcgggccgaggcatttctgtccgcctacgaggatctgccgctgccgcccgggctgaccgaggtggcgggatcgggcatgtccttcgattcgccctcgggacgcatcgtcgaggcctatgcccatgggaccgcccgcgccgccgatattctcaaattctatgccgccaccttgccccagctcggctggacgcgggaaagcgaccggctctatcgccgcgaggccgaggcgctgcggctggaaaccacccaggatcgcgccggggtgacgctgcgcttcaccatttcccccgaatgacactctagacgaagaggaaaacccatggctttcgagaacatcaccgtcgagacccgcggcaatgtcggcgtgattgccctgaaccggcccaaggccatgaacgcgctctgcgccgccctgatttccgagctgggccaggcgctggacgccttcgaggccgacgattccatcggcgccgtggtgctgaccggttcggaaaaggccttcgcggccggtgccgacatcaaggaaatggcgtccaagagctacatggacgtctatctcgccaacttcatcaccgacggctgggagcgtgtcaccaagtgccgcaagcccatcgtggcggcggtggccggctttgccctgggcggcggctgcgagatggccatgatgtgcgacttcatcatcgccggcgacaatgccaagttcggccagcccgagatcaccatcggcaccatccccggcgcgggcggcacccagcgcctgacccgcgccgtgggcaagtccaaggccatggagatgtgccttaccggccgcatgatggacgccgccgaggccgagcgcgccggcctggtcagccgcatcgtgccggtggccgagctgctggacgaggccgtcaaggccgccggcaagatcgcctcgctgtcgcggcccatcgtcatgctgtgcaaggaatcggtcaacgccgccttcgagaccaccctggcccagggcgtcaccttcgagcgccgcctgttccattccaccttctccaccgaggatcagaaggaaggcatggccgccttcgtcgaaaagcgccccgccgctttcaagaaccgttgagtttgtcgcggagtccggcgaatccgccggactccgattcaacgcttgacgaccttccggcgcggacatataaacgcgccttcgaatttgcaaccgtgttccaaggttctgatccatggcccatcataagtcggctaagaagcgcatccgccagaccgagcgtcgcaccgaggtcaatcgcgcccgcgtgagccgcatccgcacctacgtcaagaaggtcgagcttgccatcgccggtggcgattccgccgccgctcaggccgctctccaggaagctcagcccgagctgatgaagggtgcccaggctggtatcctgcacaagaacaccgcgtcgcggaaggtttcgcgcctcgtcgcccgcgtcaaggagatgaagtcgctggcctagtgccaacggcttaatatccttaagaatttcaagggccgcgctgcttgcgcggcccttgtcgttttggcgatttggggcggaatcacgagtcctgaattgcaagcaaaaaattttccatgttcgcgttccgatctcgttgcgagtcgacgggaggctcggtagagtcgcgaacctcgctggccgcaataaagtggcgccgcgaaatcaatagaattttgccttttttatttgttttctgcttcgcatgactatgtgaagcggttcacatcgtgttgatgactttttgtaatatggtttgatggtcatatttacagagggggtcgcaaaagagtatgactctgcgcggccggtatcagggcggtcggacgcatgcggacgggaccttcgggacccgagggaggggagcccagcgcatggcgccaacgaaggtgaaaagagggacggtgtcgtgagcaaggtttcacggcgctgtggggcgtttggttaaggattcggggacggcgatggcaaagtctgagtgggatcgtgtgaaggtcaggctgaaggacgaggtcggcgacgcagcctatcgctcctggctgcgccccatcaccctgcatgacatgagtgaggatgccgtcaagcttgcccttcccacccgtttcatgcgcgattgggtcaacacccattatgccgagcggatccggaccctgtggggagccgagaacccggccatccgcaacgttgagatcgtggtcgaagccgcccgcgccgtctccgttgcccagaatgccgccaaggcctccgtcgccaaggtcgtcccgtctcccgccgccgcgccggtccgcgccgccgccgcgccctgtgcccccgccgccgcgcccaacgccgacaacgacgaactgggcgcgccgctggacaatcggttcaccttcaagaatttcgtggtgggcaagcccaacgaattcgcctgggccgccgcccggcgcgtcgccgaggccgatcaggtctcgttcaatccgctgttcctgtacggtggtgtcggcctgggcaagacccacctgatgcacgccatcgcccaccacatccgcgagcgcaaccccgagcgcagcgtgctgtacctctcggccgagaagttcatgtaccgcttcatccgggcgctgcgcggccaggacaccatgtcgttcaaggaacagttccgctccgtcgacgtgctgatgatcgacgacgtgcagttcatcgccggcaaggacgccacccaggaagagttcttccataccttcaacgccctggtggaccaggggcgccagatcgtcatctcggccgacaagtcgcccagcgacctggaaggcatcgaggagcgcctgcgctcgcgcatggcctgcggcctggtggccgacatccacgccaccacctacgagctgcgcctgggaatcctgcactccaaggccgagcagatgggggtcctggtgccccagaaggtcatggaattcctggcccacaagatcatctccaatgtccgcgagctggagggtgccctgaaccgggtcgtcgcccattcccagctggtggggcgcgccatcacgctcgagaccacccaggaggtgctgcacgacctgctgcgcgcctcggatcgccggatcaccatcgaggagatccagaagaaggtggccgagcacttcaccatcaagctggcggaaatgtcctcggcccggcgttcgcgccaggtggcccggccccgccagatcgccatgtatctggccaagcagctcacctcgcgctcgctgcccgagatcggccgcaagttcggcggacgcgaccacaccaccgtcatgcacgcggtgaaaaaggtcgaggagctgaaggagtgcgaccagaacttcgccgaggatgtggaactgctgcgccgcatgctgcagggctgactcttcctcccgaaatcgcttttggactccggcgcctgtgatatactgcccagccctgcctcaggggggcagtaacgaatcatatgggtagtcagaaaagcgccatgaaactgaccatcgagcgcgccgcgctgttgaagtcgctggcccacgtccagagcgtcgtcgagcgccgcaccaccattccgatcctgtccaacgtcaagctcgagggccgtggaggccttctgtcgctgaacgccaccgacatggatctcgacatcatcgaggcggtgcccgccgatgtggtgcgccccggcgcgaccacggccccggcccacaccttctacgagatcgtgcgcaagctgcccgacggcagccaggtggagatcgagcacgacgccgaaagcggtcagctgaccctgcgctcgggccggtccaagttctcgctggcctgcctgccggtggaggacttccccgtcctgtccgggggcgagctgccgttcaccttctcgctcagcgccgccgagctgaagaccctgatcgaccgcacccgcttcgccatctcgacggaagagacgcgctactatctcaacggcatctacctgcatgccgccgccagcgacggcgtcgacgtgctgcgggccgtggccaccgacggtcatcgtctggcccgggtggagatcaccctgcccagcggcgccgctggcatgccgggcatcatcgtgccgcgcaagaccgtggccgagatccgcaagctgatcgacgagaccgacggcgagatcaccgtctccctctccgaaaccaagctgaaattcgccttcggcgacgccgtgctgacctccaagctgatcgacggcaccttccccgattacgaacgggtgatccccgccgacaacgacaaggtgctggtggtcgactgcaagagcttcgcccaggccgtggaccgcgtctcggccatctccaccgagaagagccgcgccatcaagctggccctggaaaagggcagcgccacgctgtcggcctccagtgccgagaacggcagcgccgtggaggagatcgaggccgattacacctccaccccgctggagatcggcttcaactcgcgctacctgatggacatcctggcccaggtggagggcgacaccgcccgcttcgccatggccgacgccgcctcgcccaccgtggtgcgcgagatgaccgatggcggcgccatctacgtgctgatgcccatgagggtgtgatcggcgatcgggtggcccaggcggaaccggtggcgcggccggcggtgcgccgcctgacgctggcggatttccgctgttaccggacgctgcgtctcgagacggattcccggccggtggtgctgaccggcgccaacggggccggcaagaccaatattctcgaggccttgtccttcctggttcccggtcgcggcttgcgccgggccggggcggcggacatcacccgccacggccttgccgccggatcgccctgggcggtggcggccaccctggacgggccggcggggcgggtggagatcggaacgggccgcgaggccgggcacgaacggcgctcggtccgcatcgacggcaagccggccaagcccggtgatctggccggactggtttcggcgctgtggctgaccccggccatggatcgcctgttcatcgagggggcgagcggacggcggcgctttctcgaccgtctggtgttcgggctggtgcccggtcacggtgccgaagcgggggcctacgagcacgccatgcgcgagcgcacccgtctgttgcgggcggcccgcgacggcggtcccagggtcgatcccgcctggatggcggcgctggaagagggcatggcccgccacggcaccagggtggccctggcccgggtggagagcatccgccgcctggacgaggcttgccgcgccgggctggggccatttcccgccgccggtctggcggtggagggcgagattgagggctggctggccgggggattgtcccccgacgaggccgaggagaggttcaggggcgcgctgcgagtcgcgcgcgcgcgcgacgaggcggccggggccgccaccatggggccgcatcgctcggacctgatggtgcgccacgtgcccaaggatttgccggcggggcaatgttccaccggcgagcagaaggcggtcctggtgtccatcgtcctggcccagggccgggtccaggaccagagtggcggccgggcgccgctgctgctgctggacgaggtggcggcccatctggacgaggtccggagggcggctttgttcgatgagctttgcgccctcaaggcccagagctggatgaccggaaccgacgcgatgctgttcgccggtttcggcgagagggcccagttttttcgggtgacggacgccaccgtcgctcctgaagaggtaatgacgttatgagcaccgaacccatgatccccaacgatccccacgccagcgcgaacggagccgaggaatacggcgccggctcgatccaggtgctgcgaggtctggaggcggtgcgcaagcgtcccggcatgtatatcggcgacaccgacgacgggtcgggcctgcatcgcatgatctacgaggcggtggacaacgccgtcgacgagatcatgaacggcttcggcgaccgctgcgacgtggtgctgaacgccgacggctcggtgctggtcaccgataacggccgcggcatccccgtggacatccaccccgaggaaggcatctcggcggccgaagtggccctgaccaagctgcatgccggcggcaagttcgagcagaactccaaccgcatctcgtcgggcctgcacggcgtcggcatctcggtggtcaacgccctgtcggaatggctggaactgcgcatctggcgccacggcaaggagcacttcatgcgcttccgccacggcgagcccgaggcgccgctggcggtggtcggcgaatgcggtgaccgcaccggcacccaggtggtgttcctgccgtccaagggcaccttctcccacacggatttcgacttcgacacggtggagcaccggctgcgcgaactggccttcctcaactcgcgcgccaccctgctgatcaaggacgagcgtcacgccgaaactcgcgaggccctgctgcactatgaaggcggcgtccaggccttcgtccagtggctggaccgctccaaggaggcgctgcacgcccccatcctgatcgccgccgagaaggacgtggtacggctggaactgtctatggaatggaccgacagctaccacgagacctgtctgtgcttcaccaacaacgtgccgcagaaggatggcggcacccatctggccggctttcgcgccgccttgacccgcaccatcaacgcctatgccaatgattccggcatcgccaagaaggaaaaggtcaatctggccggcgacgacatgcgcgagggcctgacctgcgtgctgtcggtgaagatgcccgaccccaagttctcgtcccaggccaaggagaagctggtctcctccgaagtgcggccgctggtggagaacctggtgggcgaaaagctggccgagtggttcgaggaacacccggccgaggcccgcaaggtggtcaccaaggtggtcgaggccgccgccgcccgcgaggcggcgcgcaaggcccgcgaactgacccggcgcaagggcgtgctcgacatcgccaccttgccgggcaagctggccgattgccaggaacgcgacccggccctgtccgaactgttcatcgtcgagggtgactcggccggcggctccgccaagcaggggcgcaaccgcgccaaccaggccatcctgccgctgaagggcaagatcctcaatgtggagcgcgcccgcttcgacaagatgctgtcctcggccgagatcggcaccctgatcgccgccatgggcaccggcattgggcgcgaggacttcaatgtcgacaaggcgcgctaccacaagatcatcatcatgaccgacgccgacgtggacggttcccacatccgtaccctgctgctgaccttcttctatcgccagatgccggcgctgatcgagcgcggctatctctacatcgcccagccgccgctctaccgcgccaagcgcgggcagtccgaggtctatctcaaggatgaccgcgccctggaggaatacctcatcgatggcggtctggccgatgcggtgctgcgcatggccgacggcacccagctggcgtccatcgacctgcgcgccctggtggagcaggcccgttcggtgcggaacctgctgactccgctgagccggcgcgtgccgctcaagctggtcgagcaggcggccatcgccgacgccctggattccagcctgctgaccgacgcggtgcgtggcccggccatcgtgcaaggattggcccagcggctcgacgcgctggaaacccatctggagcgcggctggaccggcacctgggtggaaggcgatggctacaccttctcgcgcaccctgcgcggcgtgaccgagacccatgccctggattcggcggtgatccgttcggccgaggcccggcgcctgcacgaactggccccgcgcctgcgcgagaccttcgaccgccccgccgccctgatggtccgggaacgggaaaccgtgctgtccggccccgtggccctggtcaccgccgtgatggaacaaggccgccgcggcatcgccatccagcgctacaaggggctgggcgagatgaacccggaacagctgtgggaaaccactctggacccccaggcccgctcgctgctgcaggtcaaggtggcccaggccgacgacgccgaacaagtgttctccaccctgatgggcgacgtggtcgagccccgccgcgacttcatccagaccaacgccctgaaggtttccaatctggacgtttagtgtctgtcgggtgacgcataacccgcaaacgcgacccataacgcgctaattcttgacgcgtaaaatgcaaaggccgccccggatggggcggcctttggtgcttccttaagtccgcatcgctggcgatggggctgtcttcagccccttcttgcgatccggaatgaccgggttgggccgggaggggaaaggcgggttcggacaaggggtcggcaatgcgacgtttcaaaaaagtacagtgtcaccagaaccctgtcgggttgacggaacaggccgtagcccacgcctttagctcttccagaccagtgaaggtattgattagtgcgccctcgatcatggggttgtcaccatcacatacgagctggcgaaaatcatctttaaagccaaagcagggcttgttgagcgtccaggcaacccctagctcaaatgccgctccctcatcaatggcgcgaccattcataacgatgaggaggacatcacacctctgaatcgccgttagatcgttctgaaaaatctgttttttggcttcctgagcgctcagtccagacgcaataagggcaggcaataatgcgccatcgatttgcggcagataaacatcaaacccgatctctagtgccgcgcttatcttcagattgtgcgaccgctccccttcgttgaagaggggagctgccaagtagagtagaggcttacctcgcacgctcatttctttaacttctgaaagttgttcttaatatcaaggagacatgctcccaggtcaaccggggagtagggagcaaggagcaatacccgagcaacgcgcttgaggaccgcagcaatcgaaaggccaaatgtgtcaatataagtagcagatgattcgtcaaatatatcttttagctttgcctgcatatcgcgaatcgtgtcagcacggctctgcttgtggcggccaattacacgcgcctcaagatcctctggctcccccattagaaggatgacgtgaccagcctgcggacgccgggtagcttggcccgggctaagggcactggctatcaccgtgagctactccccggaaattggacactgacggaagctacgatctgatgtttgctgatccccaactacgaggagatcagagatgtcgaagcgcaggaaccatgacgcggccttcaaggcgcgtgtcgcccttgaggcgctgaagggcgagcggacggtatcggaattggcgtcggcctatggcgtccatccgaccatgatccatcaatggaagaagtccctgctggacggggcggcggagatcttcgaacgcggggccaagaagaaggccgaggtggacgaggatacggtgcgatccctgcacgccaagatcggggagctggccgtggccaacgattttttgtctcgaaagctcaagccgtggaccggcaagtgaggcggaccatgatcgagcccaaacacccggcgctgtcgatcggcgcccagtgccacctgctgtccattgcgcgatcatcgttctattacgagcccttgggcgagacggaggcaaacctggagctgatgcggttgatcgaccgccaattcctggaaacgccgttctatggtgtccgtcagatggcttggcatctccagaacgagggccacccggtcaacgtcaagcgcgtccggcggctgatgcggctcatgggcctgatgccgatctaccagaagcccaacaccagcaagcccgccaagggccacaagacctatccctacctgctgcggggcctgcggatcgaccggcccaatcaggtctggtgcgccgacatcacctatctgcccatgcgccggggattcctttatctgatcgccatcatggactgggccacccggaaagtgctggcctggcgcatctccaacacgctcgaggccgacttctgcgtcgaggtgctcaacgaggccatcctgcgcttcggcccgccggagatcatgaacaccgaccagggcagccagtttacatccttcgcctggatcgaccggctgaagcgggccggaacccgcatctccatggacggcaagggccgttgcatcgacaacgtctttatcgagcgcctgtggcggtccctaaaatacgaatgcgtctatctccatgcctgggaaaccggctcgcaagcaagggccgggatcggaccctggatcaccttctacaaccacaaacggccccacgccgcccatggcggaaggacccccgccgtggtctactggaacaccatcaaccaaaccgatcagcaggcccggagagtagcttaaacttccccgaattctgtccaaccaatggggagtagctcatctgtcacgacggccgttgcctccaatgggttagcatccgaggctttgcgctttatgggtccctcgacagtcttgtcgggtgacccataatccgcaaacgcgacccataacgcgctaattcttgacgcgtaatgtgcaaaggccgccccggatggggcggcctttggcgttcgttgaaaccatatcgctggcgatggagccgtcttcagccgctcttgcgacccagaatgaccgggggggccggaaggagccggtcggctctcggtgaagccccctggcggcaggttgcctcgatctgcggggcgagatcggagagccgctttctcggcgaccacattaacggtgccaggcggcgcggaactgctgcatgccctcgtcaagcgcctgctccacctcgcgaaggcactgctcaagagaggcaaccttttcggcggcgtcggcatccagcattcgatcaagcctggaaggattatccggttggtggcgcagttcgcgctcaatgtaggacgcaaccgtcccaggtaccgcgcgggtgcatcctccgttggtattgatgacaatcaggggattttggtcccaaaggtcggatagatcatccactttgctgacctgccagccgaagaaatcgaaaaggagccgctggctcagagggcgtacactcgcgtcagcggctgattcgaggaaaaatgagacgaggcagtcattcttgccccggagcgttgtattatcagggtttactacggcccaccaaccatcatccttgatgatcgaaaacacatcgctttcgatcagaaccggtatcggggagccggaagccccgatgggggcgatgcccaagctgatgatgcgttgtttgttgagcttggcctcgaatttcaccatatggtcagattcggacattgtggcgaccacgcccgtatcaacccaggggctgcggaacatttcagtcgtcggcatgagatcaatcctggccgcccagaaccttgtgctgtcgcctggatcgtcggcgtactcttcatccttgaaagtctttccgccgttgccgctgaccagtcgccacctcgccagggtgctgaaataccgccgcatatcccgttgctggatcacgctgtcggcggcgagagccagcatctcatgcagatcggaaagcgagtcgtataccgtccgctcatccggggtcagccggggaatcgaggtgtcgagcagcggatcgagccgtgtcccggcgacaagctcaaactccacaagctcaggatcctcgccaagctccttcttcacctcgatcgccactttgacgtaggcgtcatagtgcgggatcagccctttatcgtcgccttttttgccgggcaggatggcaatgcgggggagacgcttggtgtagtcgcccgcatcggagagttccgccctttccagcacgttgctgcgagttccccctttgggcaggcggtcgaaaaggcgtcccaggttgcgggcgatctgggatcgttcgggcagatcgagcttgcgcccgttaccagccctgctgcccttcagaggcgcaaccttacgctccagtgccggaaggtcaccgtaggacggggcctgcatcggttcgatcgttccctgctgtggggcctcttgcgtgcgtccgccgaagtgcccgcgaatcacattgctggtcatttctgttttccttcatcagcccctgacgtgccggcgggctttgcggccccgcctgcagaagacggtcaccacggtgtcggtgtcggtgacggcgacaaggcggcgcagccgatcggcgaactggcgcccaaactccgtaatgacctcgtccaagtcgatatccctgagccagaccgattcgcagccccttcccaccgagtgtgtgccgcccccataggcgagcagggctgaaagatggtcattgcggatgcccctctgtcgcaggcgagtttcggtgtgggtggaaagatcgaacggcatggcacgccctccttgcttggaatgcagccatggtcgcgccgctcagttcctctcaccatcccaatcagtgattatatttgggatgaatattggaaaatatcgggaattgtataaatgggtgagaggctctgcgctacctttatagcggtaaaatttagcattctccgcggagaatagcgccatttaccgggaattggatggcgttcatccataaatttacggcaattcatcccaaaaaattatcaagatttggatgccgcctgaacccggtcaggcataacgtctggggcatcaagataactgcggattagaaggccatcatgaacacatcgaatgcactctcccacctgttccagcgcaacgcccgcatcgctcgccaccagatattcggtagcgatgatccgatgcccatcaatcttcaggacgatgcgcggacgatgttcgcgggctatgttggcggcagctaccggccagggggtattgtcctgcttgcggtcaatcctggcggcggaggggatgcctaccaacagacggccgaggacgttgtgttctatcctctgctcaaggcgttccgggattgcgctccggaaaaagccgaagctctgttcgggcggatcaacgatgaatttgcctcggttctgccccgatggaatttgtggcgtatcctcaagcctaccctggatgccgccggtgtcggtctcgatgaagtggcttacctgaatgcagttccctatcgcacccgagaaaatagggtgcccaagcttcatgcgaaggaagccgcttggcggatggtcaccggccccaccctggacgcacttcggccgggattgctgatcgccctgggaaacaaggcgggcgacgtaatgacccggctttacaatgggtcggccagcacggagtgtgtccccagaaccaatggcgacagctacatctctgacggtgcaaagtcagccctgaagcgaatcgcctgtcttcgaagcgcctgacggcacggatatctacttcacgtcgtaaacgggcctgctgtgatgagttggctgggggttggccgctgcatgttgcaatggaatatgcgcggccgcccccgaatgtccaccttgggcgcaaacgcgcccctgttctcggcaggttttgacacgtaacatgcaaaggccgctcctgacctgttcccctcgaatgtagccagtttgaggtagagtccgtcccatcaaggagacggaacgatgaagcgtagccggttcagcgaggagcagatcatcggcatcctgaaggagcaggaggccggtcaggcgacagcggatgtgtgccgcaggcacggcatatcgagcgcaaccttctacaaatggaaggccaagtacggcgggctggaggtgtcggaggccaagcggctaaaggcgcttgaggacgaaaacgctcggctgaagaaactgctggccgaagccatgctcgacaacgccgtgctgaaggaaatttcctcaaaaaaatggtgacgcccgccgccaggcggatcgtcgtcgcccatgtccgagaattgttcggactgagcgagcgtcgggcgtgtttgattgtggggatttcccggcgagtgatgcggtatcggtcgtgtcgtcccgacgacgcgccgatccgggcgcgattgcgcgaactggcggcagagcgtcgccggttcggcttccgacgtctgggcatcctgctatccagggaaggcgtggcgatgaaccgtaagaagctgctgcggctgtaccgcgaggagaagctggcggtgcgcccaaggcgtggccgcaagcgagccctgggttgccgggccccaatggcgatcccgcaggggccgaaccaatactggtcgctggattttctgtccgacgccttcaccgacggccgcaggttccgcatctttgccgtggtggatgattttacccgtgagtgcttggcgctggtcgccgacacttcgctgtccggtgtccgtgtcgcccgggagttggatggtctgatcgccgggcgcggcaagccgcagatgatcgtcagcgacaacggcaccgagttcaccagcatggccatgctgcgctggagccaggatcaccgggtggaatggcattacatcgcaccgggcaagcccatgcagaacggcttcgtcgagagcttcaacggcaagctacgcgatgaatgcctcaacgagacgctgtttggctcgatcaatcatgctcgggccgtcctggcggactggaaggaagattacagccatgtgcggccccacaccgccttgggcggcatcgccccagcgcaggccgccgcacgagcgcgagcgcaatgtgggccggggcatgccccggcccacattgccatcaccgcccatttcgggcatcacggggagacggggctctacctctgactgggatcaatcaggggaacaggtcagggaacaggtcaatggccttgctggtaaattccggaccattgtccgtgacgatctcctcggggaggccatgcaaagcggccaactgatcgagcaggcgggttacccgctcacccgagatcgacaggtcgaccaactggccgggactttcccttgtgtgttcgtcgacaatgttgaggacccggaagcggcggcccgagcacaggctgtcggaaacgaagtccatcgaccaacgctgattgcgccgctccggcgccgccagtggcacgcgctcccggcccgccagccgtttgcgcttcttggtccgcaccgccagctcctcgtcgcggtagaggcggtatgttcgcttgtgattgatcaccagcccctcccggcgaagcaaaacatgcaggcgcagatagccgtagcgacgatgcccgccggccaggtccttcagcctgtcccggaccgggccgtcgtcgcggtggcgatgccgataccgcgccaccgaacggtgaaggcccacgaggttgcaggcgcggcgctggctgatgcccttttccgacatcagccagcatccgacttcccgcaacgccgtgggcgtcaccatttttttccgaggacttccttcagcaggacattgtccagcatggcgtccgccaacagcttcttcagccgcgtgttttcgtcttccaacgccttcagccgcttggcctccgacacctccatacccccatacttggatttccagcggtagaaggtctgctcagagacaccgtgcttgcggcataccgatacggcgggcatctcccccgcctcggcttccttcaggatgccgatgatctgttcctcgctaaatcgactgcgcttcatttgagttcccctgtttccttcaggttatgggaactcactctccgcgtggaccggtttcaggggggaaggtcacatctttaacaatcgggcgatttccgccgcattgatctcgcacttgccggtttccccgccgacgcggggcggtgaccgggaccaatcaaggggaactgggcgcgcaaaaataaacgacaggcaaaacatatggatagccgttcacattgccgtgcgccaatccatgcttggctggagcctacggactgaagcggctacctttgcgcggcaggcaccattcctgggggaccgcgtgggaagattcttgttgctgtcgctcggtttgtttcttgttgtcggggcatttttctgccccgcccgtgccgaggcgccgaggcagggtgaggtggtcgttccgccggtcttcagccacctgactcccgcagacggtttaccctatccggtcgcgctaggcgtcgcccaagaccggcatggatttatctgggccgccacgcccggcggggccgcccgctgggacggctatcgaatgacggtctttcgtcacgacagtaacgatcccaagtccctgcctgaaaatatcgtcaccaacgccctgacggacgagcacggccaagtttggctgggcaccgcatcgggactcatcgtccgctatgatgacaacgttcaggggttcacgacctttcgcgatgaccgcggggtggggctcggccgccccaacgccatggcgggtgacggccgaggcggcatttgggtcgccagcaggctggcgctggcgcgccttgatgtcgcgaccaaggtctggcggcgcgagacgggcatccccgccggagatgtcggcagcgtcatggtggaccggtccgggcggctatgggccggcacggtcgccgggctgatgcggcaacgggaggatcggcaatccttcgagccgttgacgatgccaggcgaaaccacgaaagacatggtctcggccatattcgagggacacgacggtaccatctggttcggaaccagacggggacgggtgggcaaggtcctgcccaacggagaggttgagcttgaggcagcactccctccgtcggggcaccgcgtcaccgcctttgcggagccaaggccgggcatcctatgggtcggccaatatggtggcggcatttacgagttgcgggcggcgtcgcacatgatccggtcgttcacgcacgacccggcgatcgccaccgggctgggggacaattcggtgaccggcctgctggtcgatcggtccggccttgtctgggtcagcactctgcgcggagtccatcgccatattcccggcaacgacagcattctgaccctcgttgccgacaaacacggggggctgccggggccggatgtgcgaagcgtcgccgccagcgccgacggggccatgtggctggggttgcgtgccgaaggtctggccttggtggacagaaccgccaacgtcattcggaccatcccgtcgggtgggcaaccggacgaactcccccccggcgccaaccaagctatcgcggagaccgccgacggcatggtgtgggccggtcaattcagcggcctttttcggatcgacacggcaagcggcaaagccggccggtatgaaccgcttgatggttcgaacattctcgccctgcgcccagaacgggaccatttgtgggccggcggctccatgggcctagcgcgaatcgatcctggcagcacggaactgcccaaaatttttcacttcgatggggagaaccgggccagcctcagcgacaactctgcgcaaacattattccgcgatagtgccggcaggctgtgggtgggcacatggaaggggctgaacttgctggaagacgaggaaatcggccgctttcgccgtttcctgaacgaccccgaagacccggaaagcctgcccagcgacatcgtcaatggcatttgcgaggaccgccggggtcgcatttgggttgctacggccaacgggatcggcgtctttgacccgcaacaacctgggaaaacccgctttacccgcttggggcgccaccacggcttgcccagcggcacggttctgtccgtgatcgcccgcgaagacggcggtatcgtcgcgggaaccggagacggcctgtcgctggtcgaccaagagacctttaccgttcgaacgttcggacctgcggaggggatgcacgtccgcacgttctgggccgggtcggcgacgcgtctggccgacggaaccttgggcctgggcgggttcggcgggttggccatgctccgccctgggcctctcgccggctggaatttccgcccgccggtgatggtcacggaattgcgtatcggcggccaggtggttccgcccaccgacaacattgtcgtccgtccggaagaggggggctttcaggtggatttctcggcgctggacttttccgcccccgagagcaatcgctacgcctatcggttggtcggtaatgacgcggaatgggcgcatgtcgatgcgcatcaccgcaccgccggctacacccacttgccccccgggtccttccgcctggaattgcgtgccagcaacagcgccggcgtttggaacgatccgcccacttccctcaacgtgcgcatcttgccggaatggcatcagaccctgtggttccgggttctggccagcgcagccgtccttgcgacgcttttcgccgccgaacgggcgcgaagggcatatcattggcgtcgcgagcaatatctgaacgaccagatcgcaaccaagactgcggaagccgaggccgccaagatgtgggcattggcgggcgaggaggaagcgcacagggcgaaggaggccgcggaagcggccgcccaattgaaatcccgctttctcgccattatcggacacgaaatccgcacgcctctcaacgggctgctgggcatgctgcaattgctcgacgtgcgggggctggagcccggacagcgtgagttgcttgtgaccgcgaaagacgccggagagacgctgcgggatctcgtcgaaagtgttcttgaatatggccgcgacggcgcgagacgcgcggaaattaccctcaaggacaccgagctgcgcctccttgccaacgaaattatgggattggttcgtcagcaggcagagctaaagagcatcgccctcacactccggattgagccggaaggggccatttgggtccgttgcgacccgatcaggctgtcgcgcatcctgatcaatttgctgggcaatgccgtcaagttcaccgagcgcggagaggttgcgctgaatattgctgcagtccccgagaaccatcggagacgcttgaccatagaggtcaaggataccggcatcggcattgcgccagaccttcgcgacgccatcttcggtgatttcatccaggcggacgataccatcacccgcaaatatggcggcgccggattgggattggccatttccaggcggatggccgagcatatgggcggtgagttgagcgttgagagcacgcttggcatgggcagcaagtttcgcctgaccttgctggcggatgcgggagaggctcctgttccgggcaaggacacgccccctcagccgaccgacagccttcacgtcctggtggtggacgatgacgagatcaaccgccgagttgcggcacttctgctgttgaaccttggccacgccccggttgtggtcaccaatggggaagatgcgatcgccacgctatcggccggcacagccattgatgcaatcctgatggatattcggatgccgaagatggatggcatggaaaccacccgcaggattcggcgatgggaaaaggggcgcgacagccgtatccggatcattgccatgaccgccgacttgacggacgaaatttggcagcaatgcgagatcgcgggcatggattgcggattgtccaaaccaacccagctggatcgcttgcgtcaggcactcggcgcgccgatgcaaagcgacccatctgtcgacacgcgccatgggccggtggacctggaattcgtgaaaatgcagatggatacccttggcccgcgcgagatgatccggttggcgcgcctgttccaagtgacctcgcgcgggttgatcacggatctgaaggccgcagcagacctcctggatcgggggaggattgaagctctggcgcaccggcttcgcagcgcgacaggcccgcttggccttgtgggcatagccgatctggccggggaactcgaagccaaagccggcgttgagacgcaggagcagctccgggcgaaggtagcccttttgcgccaatcccgacgggcaagcctgaaagggtgggccaaactggcccggcagatcacctaggatcaatcactgccccaaaacgatagccgatgccggtgacggtcacgatcaatgcgctgccgccatcgggatgagccagtttgcgtcgcaggcgcgaaaccagggaatccacggttcgcgcatccccctcgccactccggctgctgaccacttcggccaggtaatcccgataaagtgggcgtccttccgcttcaacaagcgccgccagcaggtcgaactcgccgcgggtcaagacgatctgctggccggatttggacaattcccgccgggtaagatccaggatatatgctccgaaggcgaccacgttgcggcgctcgacttgctcgcgatcaagcttgcgccgccgcaacagcgcccgcgagcgggccatcaattcgcgcagattgattggctttgttacgtagtcatctcccgcgacttccaatccgacgacgcggtccagttcactgtccagctgcgttacgaagatgatgccgacggggcttttcgcacgaatttcctgcgagaagctgatgccattggcatcggggaggttgatatcgacgaaaagaaggtcgacgtcacgatccttaagcagcacccggcattccgccgccgaagccgcttcgcggacctcaaagccctcgttggagaaataccgaccgatcatcgaccgtgtgacggggtcatcttccaacacgatcagacttggacgcgcgtcccccctcgccgacccggtcggcgcgcaaccgtcatccgtgcccattcctcatgtcccatgcccatttccctcgtcatcataatcctggcgctggggcagtacaagcagatgggggcaaaaaaataacggatactgcacctcgatcaggaaagcggcagagttgcccgcagctatttagcgatgatatgtttttttactacaggtggttcggtttcggtaagattcgcgatgtgcacgacaatatatcgcaaaagtcgagagctgcagggcgcaatcgagacgccaactcttggaccacacacattggcgacgcggcacgttgtggaaatggtgtccgcagcgtccagcacggacgaaatcctgacattgatctcttgcccacgcacaaatccttcgccttcgaaactaagccccccaacagagatgtcgatgaatggatggatacatccattgactttcagcaccagggtttgccctgggtaacgaacggcctgccgctgttcccaacgaggctgtctcatgacgtctccccccgcggctcagcctgccgcactctcttctgccgacgacagcaaaaggtcgatgaaaaggcgcagcatttgcgtgtcgagatggctgcccatctcatcgtgcatgatcttcagggcattctccggctccatcggcggcttgtagcaacgtcggtcggtcagggcgctgaacacgtcgacgatcgcggccatgcgggcaagttcattgagttccttgcccttcaagccgttgggatagccgctcccatccagcttctcatgatgctgcgcagcaatcaggccgacgcccttgggcatggtcgggcactgggtgatataagcggccgaactgtccacatgtccgcgcataaccgcgaattcgtcatcagtgagacggcccggcttgttcaggacttcgtgcggaatggacattttgccgatgtcatgcagcaggcccccgcttgaaagcagcagaaggtcctctcccttcagccccattgcatggccgaatagcgacaggaacgtcgcaacgcgcatggagtgcacatacgagtaattgtcgtggccgcggacaccgttcaggatcgccttgaagtcgtttcgctgcaccgcatcgacgagcggcgaacatgcctctcggacggccacgtattccacagcttcgccgcgatcgatcaaatccgagatgccgttgaacgtttgcaatgccgaggtcagggcgtggcgatgataaagccccaatctcttccacccggcctctatcgagtggttgaccagagaggagatcgtggagatcagttcgctccggcggaagggctttgataggattgcgtcgcaccccaattcctcggccgtggaaaagagcttgctgtccacctttcccgaggtggcaatgatgcggacctctttcagcgacggcatgttgcgaagtcgtctaatggtctcccgtccaccaaagggtttcgcgctctcgtccaccaccagggccaggggcggctcgcggcgcaggtgcggcacggcctctcgcagatcctcgaaacaggcgacgcggtaaaaggacgtcagtgcctggccgacctgaaggcgatgctccgccatgccatcaatgacggcgaccaaaacccggggggctgccgccgacgcgtcacgtccgatcgcgcccatgccggccctccgcaagaaggcatacgtcaacagattgccgctccgccccggcaatcattgaagaccgctatcggcaaaggcaagacggcacaggatctcatgtctgttggcgcttttaagcaagctgcaacgggccgctatagggggggagaattgctccagcaccacatctcgcatggcgcacccctccatggtgtagaaatacaggagttcggccgaggcgtcccagcccatcagacgcatgatcgagtccaggttgtccagctgcctccggatttttcccggcagtcgaacgctatggtcgaatgacagaacctgtccgtcacaatcaatcctgagatcgatgtaagtcttcacagtgccccccgcccaagccccacgccggcagcttgcgtgccccggcacccacttatctaagacaatggtatggacaggatgtggatgggcttgggacgacgatgcacaatgtgacctgctgccggtttggtggacaccgggtgccacatggacggcctcggtagcgccattgccgcacagcgcaatcggcgctaaccccttgaaaaagaaaccccccggttatgcaccggggggtaaagtcaaacagggaggcttcacgtctaggagactaagagctatgtctttttcggtgaattttggcggaccatggtggatggtcatggatagatcatccacatgatatctattgagttttcatggattgtggcccatggtcatattcgtggtcattcgcagcaatacgctgtccgccagataaaaacggcccacatacggcccatggaataattctaaataggtgtagcttggcgaaggctcttacagactcagtggttaaaaccctgaagccggaacgtggggcaacgacgtggcgcgagatttcggactccggctgtcgcggcctgcgcctgcgagtgtccccttctggggaaaaggtctgggcagtcaaggtcactgtgggtgcgcagcgagttcgccacaccatcggggcctatccggcggtaagtctgggtgaagctcggaagcgtgcggaagcttatcttgcaaccgcccgtgatggtgcatcaccggatgaattggatgcccggcagagagcggagacaatgaccgtcaccatggctcattcggaatatatcgaggccatgcgttcatccctgcgtgccagcacgatcagtctcaagaagacgatgttcaagacccatgttgagggcgctttgggcaaacgcctgatccgtacagtccgccgctctgatgtggtggacgtggtgggcggtgtatcagccaaaggctttcccgtccaagcgaaccgggtcttctctgaagtgatggcgttgctccgctggtgcgagcaaaagggatacgttgatggcgttccgtccgctcggaaaaaggatgtgcgggcggcaacggggggcgcaaaagaactggcccgccgtcgcgtgttatccgagggtgaaattattgccgtttggaatctgacagccaacatgggcgatcttaccggcgactttctccgccttttgctcctgaccggccagcggcgcgatgaggtgcgcttaatggtttggggtgaagtcgatatggacgccagcttgtggacaattcccgccagccgctacaagacggggtactcacacacagtgccgctgccgaagcaggccatggacattctgcgcagccgctgggtggagggcgcgaccggctatgttctggctggtagaggggagaataagccattcaatggggccgcctccgctgtgcgtcgtttgcggaaggaactggggggcaaagctgatttcactttgcatgatatccgacgcactctccgcaccggccttgctcggatggggattgatgagacgactgcggaaatggtgatcggccacattccccagggaatcgtaaaggtctatgaccagcatgaccgcatggaggagcgtaggacggcgctcaagcggtgggctgagtatgttgagcgcgtggctacagttggaagcaacgtgtttgccctgcaagcaaccaagggagcaggctgatgccatatctcgatggtttgacgccggacaacgttggcgagggaagcagccgcctcaccgttgcctacttagaagcggtgatgctctttccaaacgatcctgaacggcaggcccgcgccatgatggccgttgatgtctcgctggaagtagacaggcatattcagcatctcggccccgatgaactggttcctgcgagggatatggcggctttggtggatagcgttcgccgcgccccgaggattgaggaattcgcctccgtatcaaagcaggcgatgaatagaggggtctttgcaggctatgtggttttgcacgtcctagcgagaaagcaactttctccaaaaacagcaacaatcggacaggctataaagcttgcaattgaagcggggtttggcgactctgcatcaaattttaacaagagcgtacggagccaattcatggctgtttcccatttgtgggcggcatttgtgatgctagctcaagagagggaagcagagtgggcttttccctgtagattagattcaatcccatacttcctggccacagccgaggttataagacgggagggagaaagttttaagcctccgcaaagcaattccacccttcttaatccctcgatatcgctgaaggtgcccgaaggcatcgcactgccccagatacagcctctcgtattcgagagactttgaagcttccctgctcaaatcgccccatctgcgagtgagcgcgcaatcctttataccggcgggtgcagaggactttgttcctgcatattcggttgttgatgaacggggcggatgaatgtgaataatgcggtgccatcacgtactagcgaggtggcccatgaaaaccgagactactacccccattcttgttgcgcccaaatacgcttgcctgcttcttggcgtcggcaacactcatctttacaagttgatcaatcagaagaagcttgatgttgtgaagatcgggaaatcgactcgtatcacgatggagagcattcgtgtcctggcgggtgtgcagtgatgggcgggggcttgaccatcctgcggtcgtgttcggggaaggccgcaacgaaggtcttctgcctcgaccatgccgggaaagaagtttctctgccgtatggtagagagatgtacttctcagcccaaaccgtttctgtcgcctccatctatgaactggcgagcttgctgacatcgctggagtctgatcggttagcctttgtcgttcggggagagcttgccccaacagccaattccaaccgcaccagaaggttgcttcactccggcccgaaaggggaggccacgttcctgagttcggcgcggccttgggtgatgatcgacattgatggcatcccgcgccctcctaacctcggtcatgatgggctgattgagtacctgatcggtctgcttcctcctgagttccaaaatgtgacctgctactggcaatggtcatcgagccagggcaggaagccgggcctgcgcatccatctctggttttgtttgaataggccgatccctgatgcggaccttaagcggtggggcaatgccgtcaatgcggcttggagcgatgcaggcaacagcggcaagcttatcgacaccgccctcttcaatgcggttcaggcccattataccgccgcgccgctctttgaggatggcattcaagaccctgtgccgcgtcgctccggcctgcgtcacgggcaggtcgatgttgttgcccttgttctacccgagaaggtcgaaagggcgcgcacagacagtgctgggagttctcatgcgggattgggtgtccaaggtcatctcgatgccatagggggcgcccgtggttttcatgagcccatcaaggctgccattggagcctattatgctttgaatggtgcgaacgccaatccagatgcaatcaaatccatgctgcgtcatgccatatccaatgccgaccctaatggacggtcggcggcagacatcgaacgctatctttcagaccgctatcttgatgatctaatcgagtgggttgcggtgcgacaggcagaggcagaggaaattgttgaaccgtcctggccgttgccaacgcgtggtatccaggccattgccgctgaggtcgagctgcacattggtgcgtttgccatatcaaccctcgtaaagcccgccgatggatcaaaccatccgaggcagatcggtatcattggcgactgtgcggcaggcaagacccgcgccattatcaagtggagccacttgctatggggatagcccatttcgcccccggtcatgttcagactgctgatgtagagcaacggtggggaggcaaggcccaacggtggctcggcaccgaccaacctgacccatcgtccacagatgttcgcatgtgccgacgcaacgataccatgtcgcttgtgctcaatgctggcggcaagcagtcagacttatgtggttcaagagtgcgaggatactgcccccaccatgagagtggggacggtgatctatgcggatatcggcggcaacatatcgtggcggcggaggggcatgttcagcattggtgtttcacgcatgcaagtctgccgcatccgatgccggagcctttaaaggggcaaggctttgatgaggtcatcattgatgaatccccaaaggggcaaggctttgatgaggtcatcattgatgaatccccatggctgacaacgatgattggacatgaaaatatcttgattgattcgttgatttcgaaaaaatggataattcctgacgcagagagtgattttgtcggcctgccgacccatagaacaaatcagttgctgcaatatattattcaagcgttctgcgcatcaggaattggtcggctgcgcaagtcatctatgaagatgatacgctcgctcgagtgcaaaaccgttatatattatctcttgcgcacaaaaattgagattgccgacatagtcactcccgaaatgtccaaggctgctgccgagagggcgctggaagcggcgaagtcgcacaacgcccttctgatgaaattgaagcaactccttgaacttgttgtgctgacgcttgaggggccaggagacgaatcgccatatctacaggtggcggatggctcttccgtgacaatgatgtggcgcaaagacatccatgaggactggtattctctgcccatagcgcatctcgatgccaccatgcagccagagattgcccgtcagtggctgcctgacctgagcattaaatcgtacgcagagacagccatggtcccggaaggcgtctatatccggcaagtgcgtgaccaagccgtttcatacaccatgatccggcctgacgaaaatgcgagccctcaaaaccaacagacccagcgaaacaactgtgcctgcatcgctcggtttttggaggccaaggagcatcaatatgcggctcagagaatggtcgccattatgcccaagggcaccgaggccgaggtgctgcgtactttcaccccttctgccaataccggaatagcccactttggcaatattcgtgggttcgatggctggaatggcgtgggctacgaggtgatcattggtcgcccacagatcaagccatccgatgccgaggaaattgcgtgggttgtttttggcaaggtagggcagtctctcaatggagagaggtaccctgtgcgggacttcaagcggttaatggctgacggtacaggcagacatgccaaacaggtctaccacccagacccctgtgctgaggcggtgcgctgggctcacactgaaggtgaattgcttcaggtcatagcgcgcgctcggcatgtttggcgtgatccatccaacccactccagattgacattgccaccaatgtgccgctgcctattccggtgaatgagttaatttcctgggatgacctgatggccgaagccacccccctggcattgatggcggcccgaggtattatccccgacgattggaacgggcgtgcgcttgttctctcagataaattccccactgtcgatgcagccaagtcatgggcgcacaggaatggcgctattgacttcgtggcaaactccaataataaggttactattggagaacgtcacgaagtcaatatcagaccctaccgttatcgaattgctgggaaacgtcagagcagcatcttacatgcccggtctgatatttctgatccgcgagcggttgcggaaaaatatttaggcccgttggaccgctgggagttggttcagaagtctatcgagggattgccgccctccctggttctctctccggttcgcggcggtagtgttgtcgtgcccttgggcttttccattcgggggcgaccgctggaggaattcatgcgtgcggcggcgtaaaaagcaattcccgttgcgctgaatggggccgagcatcattctttcggttcaggccaacgcccaatggggggtagcgcatgaagcatttcggcatatccccacccgtaccgacccgccgtaacaggcggtgcatgccatggacggcgctgctgaccctcgtgctgttggctgccccggccatcgctgctgaccttcccgccgtgggaacccgcaccattgggagccagacgtatctggttgaccgcaacggcaacaccgttgggcaactcagggagctatcccccggcaattggcacatcactgacaatcgcggcatgacggttggcagggtccagacgcctccaggctcacccccgcatgtggcgggcgctatggcggtgcggagatgagtttgggggattttaatttaccgactgattgtgtagccatattttcgagtcatgcaatcccgctcgttgtctccaacaataagtggattattgccatagccctgtgcccttgttttctgcagtgctagttgttcgcagtcgtatttatccgctgcctgctctgcggctgatttattcgggtgatatattttatatggcgtacatgccgtaaccaaaagaatcgtagacaggcacgtcacgtacaaggctatcttcatttagctgtctcccatttatctgcatgccagtcatttggcgggggggagtcaaatctctagccgatcactcgccttgaccgactccctggtcaagttcccacgccgccgatattctatggtaactaacgttaaataacgccttctgaggcagaacagcttttcatgcgcgtcgcttggtattgttcttgcagaatagtgatttatcacttttgctttagtgttttattttgcctttgattttgtttatcggatttcacttttggctgcgccgcttcttctttgaccttttggggtggaaatctcgcgtcaatcgcctctaactgagcgataacctgtcgcggcgttatatggacaaccttttcagcgccgtttttggcactaaattttatccggtagcccgtttctctcttgctgcgcaatgtcttgtcatcgatcgaggcgccaaatgattcaaaataactgcatccatatctgcaactgccgacatggctagatatagatacgaattccattatgttggagttttcatcttttgccgaattccaaaatttccatccactcccataatcgttcacatagacttgatgtgttgctaccaatgtccctttgtcaacccagcttcgaataaaataagtgttgaactcagaaagaacaccagctccaagtgtttcctctgggcctataaataatacagacttttcgaactgatcatcttttatgtcaactgtgctgcgcagcctggaagtttcaatagtgcttgatggctgataccccatcttttggggtgtgcagcccgtgataaacagggctgtcattacaccggcaatcaaaaacgtgctgcgctgcattatctctctccccattcggctctcctcattctcctgttttgggagaattcgtccaggggaatttgctgtcgtgagctatcacaaccggctccacgatgcccaagaccattcacacggaacgtcaccacaaactgcgggcgctgttggtcgccgaacgcaaggcgcgggggcttacgcaaaccgtgatcgcggagcgattgggaaaacctccgtcctatgtcgccaagtatgagcttggagagaggcgcttggatgttttggaattcctggatgttgcggcagccattggctttgatccctgcaacctgatccgctcgcttgcctccgtgtagcccttgccctacgccgcccgtggcgtcacgtcgtgtgcaatcttgtctccggcctcagcttccacctttgacaggtcatgggcgctttggaggttgagccagaattgtggcgtggtgccgaaataccgggccaaccgcaaagccgtatcggcggtgatggagcggtgctccttgatgatctcgccaatgcgggttgccgggacgcgtaacgccgtggcaagggcgttggccgacagccccaagggggccatgaattcttcgcggaggatttcaccgggatgggtcttgatgcgcatgatcctgcctcaatggtagtcggtgatctcgacacggtgcgcggcaccatcacgccatataaaacacagccgccactggtcattgatacggatgctgtgttggcccttcctgtcgccctccagagcctcaaggcggttccctgggggtgaggagaggtcttgcaactcggcagccgcatcaagcatgtccagcttgcgtaacgcggctttggcgatagcggcaaaccgcttggacgtgcccgcctgatataggcgctccgtttccttgtcgtgaaagctggctatcatgtgacaacgatataacgcgccacgtataacgtcaatcggtgcattggctgcgcggcttgcgtcgcgctctggaaatcaaaaacggcccacatacggcccatgagcctcggacccgccaaatcggcccaagcctcaaaacctcataacccattgaaaaagaaagcccccggttattcaccaggggctaagtcaaacagggaggcttcacgtctaggagacgtagggtccgaagacccggaacccaggcattgcacctgggaacactgtggcgggaaccgccgaactctggacctgctgcgctgcagcaagttgcgagtactgatgtacggcatggagcggcctcaaaccacaccaaaaagcaggatagaggcatgcggttggcgcatgccttatgctttcgggtagggtttttaccggatcaggcggattcggcgatcttggagagcaggaagtcgcggaagaccgtgatgcgcttggaatggcgcaattcctcgggatagacgaaatacgtctcgaccttggggcccttcagctcgggaaggatatgcaccagcgcctcggcctcgccgcgcaggtattcgggcatggcggcgatgcccagtccgcttttgacggcgcggtagatgccgtagatgttgttgacctccagcaccggcttgcgcggccggtcgggggaggcgccggcttccagcagccagttgacgttggacaccggggccgagacccgggtgtcgtcgccatagacgatgatgcggtggttgtcgaggtcgtcggcggacttcggcattccgtatttttcgatatacgagggcgcggcgaagacggcgtagttcatggacaaaaggtgccgctggatcaggtcgggctggcgcggcggcatcatgcggatggccacgtcggcctcgcgcatggccaggtccagctcgccgtcgaacagcaccatggtgaccgcgatctcggggtaggcgtccaggaagtccttgatgcgcggcgtcagccacagcgagccgaaggccacggtggtggtgatcttcagcggtccctgggcgcgttcacggctttcggtcagcagggcctcggtcatggccagcttggagaacacgtcgcgcgcggtgcggtagagcagttcgccctgctcggtgaggatcaggccgcgggcatggcggtgaaacagcggcaggttaaggctttcctccagcgcactgatctggcggctgaccgccgattggctgagattgagcacctcgcccgcatgggtgaagctgcccgcctcggcgacggcatgaaaaaccctcagcttatcccagtccatgtggcgaccggtctcctccccgcggcggattatggtttccgccctcccatttcataccggctactgtgccgcaacttaacccgtgtgtccatgcgcggtgaggaagcgctcggcctccagcgcggccatgcagccggtgccggcggcggtgaccgcctggcgatagatcttgtcctgcacgtcgccggcggcgaacacgccgggaatgttggtggaggtggcgccggccttggtgatcagatagccctcggaatccatttccagggcgcccttgaacagctcggtgttgggcgtgtggccgatggcgatgaacacgccgtccactggcagcacggacagcgcgccggtcttgacgttcttgaggcgcaccccggtgacgccaggagggttgtcgtcgccgacgatctcgtcgatgacgctgtcccagaccacggcgaccttgggattggcgaacaggcggtcctgggcgatcttttcggcccgcagcgtgtcgcggcgatggatcagggtgaccttggaggcgatgccggccagatagatggcctcttccaccgccgaattgccgccgcccatcaccgccacttccttgccgcggaagaagaagccgtcgcaggtggcgcaagccgacacgccgaagccggagaacttcttttccgattccaggcccagccagcgggcggtggcgccggtgcagatgatcagcgtatcgccggcataggtgtcgccggaatcgcccacggcggtgaaggggcgcttggacaggtccaccgagacgatggtgtcgtccatgaagcgggtgcccacatgctcggcctgggcctgcatctgttccatcagccagggcccctggaccgcctcggcgaagcctgggaagttttccacatcagtggtgatggtcaactggccgccgggctgcagcccggccaccagcatgggctcgagattggcgcgcgccgcgtagatggccgcggtgcagccggccggaccggaacccagaatcaggaccttggagtggtgatgcgccatcgcgatgcttcccggacttttcgaaattattgcgtcacagcataaggagagggcgcgccgctggcaagcggcgcgccctccctatcttacaaaagccttacagctcggaagcgtgcttggccaggtattcggcaacgccgttgggattgggcttcatgccggccttgcccttgttccagccggcggggcagacctcgccatgctcttccgagaactgcagcgcgtcgatcaggcgcagcgcctcgtccacgttgcggcccagcggcaggttgttcacatgggccgactggaccacgccgttcttgtcgatcacgaaggtgccgcgcagcgccacgccacccggcagcaggacgccataggacttggcgatgtccttggtcaggtcggccaccatggggaactggacgttgcccaggccgcccttgtcgacgggggtgttcttccaggccaggtgggtgaagtgggaatcgacgctgacggcgatgaccttggtgttgcgctcggcgaaggccttgacgcggtgatcgtgggccaggatctccgacggacacacgaaggtgaagtccagcggatagaagaacacgatgccgtaggagccagccaggtacgacttcaggttgaacgccggattgatctcgttgtccggcatcaccgccggggcggtgaagtcaggggcggctttggtgaccagggaggtcgggctctgaatcgtgtcggacattagaaaggctccctcatagggcttggacaaaaatgatgccgacaaatctagtctggattgccgtgtcgcgcaagatggaatgattacaaaacagctgccatgaccgcgcttgagaaggatattaactctcagtttccctgtggtcatggctttgggagcgggcgggggagcccgcgctgggaaaatcgtcgccgcgacagaacgttgggcttgctggcggcttctgagtaatataatttcgcaaacttacgtggtattggagttcccttatgcagcgggtcaagcttgaccgcatcgatcggcgcattctggccgacctgcaggccgacggccgaatgaccaatgtcgagttggcacggcgggcgggaatctcggcgccgccctgtctgcgacgggtgcgggcgctggaggaggccggctacgtcaagggctaccatgccgagatcgaccccggggcgctgggattcaacgtcacggtgttcgcccatgtgggcctgaacagccaggccgaggccgacctcaagtccttcgaggagctggtcaagggctggcccgaggtgcgcgagtgccacatgctggcgggcgagaccgacttcctgttgaaggtggtggcccatgactgggacgactaccagcgtttcctcaccacgcgcctgaccgccgcacctaatatcagccacgtaaagagcgccctcgccatccgcacctccaaactgcagcccggcgtgcccatcgacgtggaggccgggccggagcccgagcacgaatagagtccgacgggaggagggcgcggtggatatcgatcagatccgcgtaaagactaatttcgacattctcaatctggcggcggcggcccggcgggcggaactgtgcgccgcgctggccaaggcttccaacatgaaggtcctgggcgggctcttcaccggaatgaccctgtcgggcgagagcacttggcacgacggcgacctggctcccaagatcctcggatgctacgaggaggaactgattcccgcctttacccgggccatggaccggatgccgcccgtggtggtcaatatcggctgcgccgaggggtattacgccgtcggcctggcgcgggccttgccccaggcgcgggtcttcgcccacgacaccgatgccaattcccgacagtactgccagcgtgccgccgctgccaacggcgtgggggcgagggtggtcgtcgacggcctgtgcaccagcgacaagcttcggagccacctgtccggccaggggcgggccttgctggtcgtcgattgcgaaggggcggagatgactttgctcgacccggctccggtgccggagttgtgtgactgcgacatcatcgtcgagtgtcacgacttcctgaaccgcgacatcaccgaaaccctgatccgccggttctctggaacacatcaggtggaaaagatttccgaagggccgcgcgaccccaaccggttcccggtcctgcgccacatgtcgtccctcgaccgctggctggccgtcaacgaggggcgcccggagaccatgtactggctggcctgctgggccaactgagccttaaaagcctgaagggttcgggacgctgtgcttcacgattgggggatcgggggcgaaagcccccgaaggggagcctttccgccgcccctattgcgccagccgctggcggatttctccctcgcagcccatcagccaggcgatccgcttcaggcgggcgctttgctcggccatgtcgtggcgttccttttccgcccggctgtcgatgcggtcctgttcccggttgaggcggtccatgcggccttcgatggccgaggcctcggccttgatctgggcatcgatgcgggcgcggcgggcggggcgggccagcaactcgtcgcgttcgaccagtaccgccgtcaattgcttttcccagaacgtgccgggaaacagggcggcgctgagcgatggcgggccattggagggggcgcaggactcgttcagggatagggacgagggcggcaggagcgcccagccgagaaaggccagcccggccccgataagcagcatgtcgcgaaggcgcagtgtcgtcatgaccgttcctcccgttccggccatgataggacggcgttccccttgcgacaattgcggatctgccgggcaaggcttgcatccgggacgcattttgccctttggccaccttgtctggccgggcgggcatgcgtacctttacctaatgcgagggatgctggaggttgggttgcccgtcagaacgcctcggggcatcggccccggccgggagagcttgcgcgacgaaacgccggcccgcttgcgggcgcgggtcaaggcgctggaaattgcccagcgcgaggcgcagcgcacccagcgggtcctgctggccaccacgcgggccctgcgcgagagcgaggagcgctatgccctggccatgcgcggccccaatgaggggctgtgggactggaaccccatcaccaaggagctgtacctgtcggcgcggctgctttccattctcggcttcgagagcgacaccctgcggaccacctcccatgaatggctggagctggtccatcccgaggaccgcgaccgctatcaggccaccctggtgcgtcatctcaaaggcgaggacgcccatttcgaatgtgaataccgggtgactgaccgcgacgggcggtggcgatgggttctggcccgcggcctggcggtgctcgacgccgatggggttgcgacgcgcatggtgggctccattggcgacgtcaccgagcgccatgcctaccagcgcgccctgcaggaggccaacgaacagctggagcagcgggtcgtcgaacggacccgcgaactggatctcgcccgatgtcaggccgaggaggcgaatcgctgcaaaagcgagtttctggccaatatgagccacgaactgcgcacgcccttgaatgctatcatcggattctccgacgtgatgcggtcgggggtgttcggtccggtgggcaatgcccgctatggcgagtatatcggctggatctgggattccggccaccacctgctccgcatcatcaacgacatcctcgatctggccaaggtcgaggtggggcgcttcgacctcagccgcgagtcgacccccgtgctgcccttgctggaatcggccatccggctggtgtcggaacgcgcgacccgcgccgaggtcaacgtggggtgcaaggcggagcccggcctgggcgacgccatgctcgacccgttgcgcatgaagcaggtcctgctcaacctgctgtccaacgcggtgaaattcacgcccgccggcggatcggtcagcctggaggcccgtcatgaggggactgacctcgttctgatcgtggccgataccgggatcggcatggacgaggaaagcctggaaaaggccttgcagcctttcgtccaggtggagtcgagcctgtcgcgccgttatgcggggactgggctgggtctacccctggccaagtccttctccgaactgcacggcggcagcctggatctggtcagccggccgggcgagggcacgacggtgacggtccgtattccccgcaaatgattccttcccgccatagcaatgcatgaggtttgtgcatggctgacctccagtgcctttcgcatgtgcgagaagcggtgtacatggctgggaaaggccgcgccagtcgagcggccaaggagagaaccatgatcgtttccaccatggatatcgtgatggccgccatcggcgccctgagcatcgccggccttggcatttccatcagcgcctggcgtcacgccgcccgggtcgagcgcgagctggacaaggaccagcacgacggcattccctcggcgatctgatcgcctttacgccgggctctcgggtgccgagagccacaggccagtgcggtcatgccgcaccgcacagccggaccgggccgccagagggcccagccggccgcgaatatccaacccaaaccgcctgatcagatggtcgccgacaccgccggcggcggcccagccgtccggccgggcaatctctccgatcaccagccgcagcaggccggcttcgtccaggtcgaaatcctggcgggcggccatgccctctgccgtcatccgcgcgatgtcgacggcaaagcccttgtcgttggaggcgatcaccaccgggccgctggtcccggcggcgatcagggcgtcgacggtgcgggcgatggcctggtccgccgcctgggagggcgcgtcgtcgggaaccggggtctcggccgccgccgccaggccccgcctggccagggccatgcgccatggcgccatgaagccttcgcgcccgaacagctccaggcgcccggccccggcccagcggcccagggattccagccgtcgggtgccggtcagattctcgcagtcgatcaatacgatagcagcagtcgacgtcatgaaatcctatctcgcatggcacaattctcacgacacggcttcccgttcggctccgcgtcatataacctcagtccggtcgggccgcttttggcctcggcaagatgatcatctcatctaaggtgaattcggcgggagtaggaatgttcaagcgcaagtccgttgatgcacaggtcggcgacatgttcatcaaggcccacgacaccaagaagagcatctgggtggtcgagaagattttcgagcacgtggacggcatcatgcacgcccgcctgttcaacaagctgcagcccaagaccatgatcaccgtttcggcctcgaccctggccgatcccgacttcttctaccgcgctcctccggctccgctggactgagcaccgggctccgccgccagggccgcaatcggcccggcgtggaccaccgtgggctgctggaatgggttgccctgcaccagcacgatggccgccgtcggcgccgccgccgccgcgaagatcaccatggcaaggatttccgcccgtccctggtccacatggaccatggcgatggaaatcatggtgagaaagccgagaaaggccatgcccagccatttcagcggattgacgtgggtttgggacagcgcgatgcgtaatccccgggccgcccggacctggacggcctggctcagcatcagcccatgcactccggtcggcgccaccgccgagacatccggccccgccagcagcgacagcagtctgtccaactggtccgaggcggcgcggctgttctggcgccgcgccagcaggggccattcctcggtcaccgtgatgcgggcgtagtcccgcaccgctcccaccaccctggccttgatcggggcgggcagatgctcggccagggcgtcgatgctgcgcagcccgtcggcttcctggtaaacggcattcagcgcccggtcatgggcgttccaggtgtcgttggccaggaaggccagcgtcagggcgaacaggacgcccaccaccccgagaaaagggggcgacacccccctccaggtgtgaagctcgtcggcccagggcgagcgtaaggtcacccacagcagaaaccaggcgccgacaaaggttccgagcagggcaatggcggcgtagccatagtgatcataggtaccgagaatggtggtcatagagcgttccttgcggcgaacggtctatttcaccccagcgggaggcggcaggccagcgattaaagcgccgagcctcaaatgtgaggcgcggcgctcatgcgagcattgagcgagcggccaagggcgcggaggcgtccgcccggcgagggcaaaacaaataaagttaaaaagagtgatgcatgtttaaggcatccctctttggttcagcgatagccgtagccggccatgtccagatggctcttgaagttgatgtcacccttcaagaggtagtcgacaaaggccatgcgcatttcggtcgccacccgccgggcgtcggcaagctggctggtctggccttccacctgatccttcagccggtgcagccgcgccagattggccgcctggacttcgcggatctggtcaacgccgggataggacgtacggaccagaaggtccagttcctccgcctgatggacggtcagaatctgcagcagatgggtgagcagtccaacggcgtcagagcggcgattctcggacaacgccacctcgatctcgccaatggtgttcaggtgttgccggtgggcgcggtcgaattcatcaactccgacgctcagcgcatcgacccagaaatccgtggacatggagctcgtgtccgcatttgtgaatttcgcgggttcgatggtagcacacggctatacttatcgccaaggtcgttggtcaagccaagctaagcgcgggcgcgggcaaccttcgagcccgtggcgcggccaagcgcctcgcagatgaaggttccggcctcgatcagcctgtccaggtcgatgccggtgtgaatgcccatgccgttcagcatgtagaccagatcctcgctggccacgttgccggcggcgcccttggcataggggcagccgcccagcccggcgacggaggaatccatcaccgccacgccgcgctccatcaccgccagcagattggccagggcctggccataggtgtcgtggaaatgggcggccagcatctcgacgggcagccgagcggtgaccgcgtcgatcatggcctgggccttggcgggggtgccgacgcccaccgtatcgcccagcgagatctcgtagcagcccatggccaccagcttttccgccactccggccaccgccgagggctcgaccgcgccctcataggggcagccgagcacgcaggagacatagccccgcacccgcaacccctcggccttggcccgggcggccagcggggcgaagcgctccaggctttcggcgatggagcagttgatgttcttttgcgagaaggtctccgacgccgcggcgaacaccgccacctcctcgaccttggcggccagcgccgcctccagcccctggaggttgggggtaagcacgggataggccacgcccggccgccgcgtgatggcggccatcacctcggcggtggcggccatctgcggcacccatttggggctgacgaagctgcccgattcgatggcggtaagcccggtcccggtcaggcgattgatcagcccgaccctgatctcgacggcgaccggcctggcctcgttctgcaggccgtcgcggggaccgacctcgacgattttgacgcgcgagggatgacgcatgatctcgaacctttcccgtccattcggggctgccgccccgttccccgcctggaggagacctccaaacctccctttcattcatgaatcaaaagggggtttggggcattgccccaaatgggttcgggcgatagcccgacagatcctattccttcacctcgaaggccagcagttcgacgccctcggccacggtgtcgcccaccttgaagtggatggcggccaccttgccctcggcgggggccttgatggcgtgctccatcttcatggcctcgaccacgatcagcggctggccggcggtgacggcgtcgcccggctggaccagcacctgaaccacggtgcccggcatgggagcggccaaacggccgtccccgccctcgcgctcggcggcggtggccgacgggtcgtccagcttgatcttccaggcgtggccgtcgtgcagcacggtgatgtcgaagccggagcgtaccaccgaggcggtgcggcgttcgccgccgatttccgccgaaagcgtggtgcccgacagggtggcgcggcgcgccgacagggtctggtcgggcaggtcgagcgaccagccgtcggcgacgaaatgcacggtgacccggcgctcgtcggccccgtccatgaagcggaagtcgtggtgattgtcgtcgttgaggcgccagccgttggtctggtgccagggggaatggggatcgccggagcgggcggcggtccgggcgctatcctcttcgcgccacagcagcagggctagggaggcgaaggcgaggcccatggcgggcaccggggcggcgggcggctgcagatcggcgcggtagcgctcgatgaagccggtgtcgatctccaaagcggcaaaggcagggtgcgcggcgatggcgcccaggaaggagacgttggtggtcacccccgccacctgataatcggccaacgcccggcgcagacgccgcagcgccgagtcgcggtcctcgtcccagacgatcagcttggcgatcatgggatcgtagaagggcgtgacctgatcgccctggcgcacgccggtatcgacgcgcacgtggcggttttcggacgggggcgccagatgcaccagcttgccgatggccggcaggaagtcgcgggacgggtcctcggcatacaggcgggcctcgaaggcgtggcccttgcgggagagctgttcctgggccaggggaagcttgccccccgacgccaccagcaactgccactccaccagatccaggccggtgatcatttcggtgaccgggtgctccacctgcaggcgggtgttcatctcgatgaagaagaagcggccgtcctggtaaaggaactccaccgtgccggcgcccacataatccaccgcctgcgccgcggcgacggcggcctcgcccatggcgcgccgggtctcgtcggccaaagccggggcgggggcctcctcgatcaccttctggtgacggcgctggatggagcaatcgcgctcgaacaggtagacgccattgccgtgggtgtcgcagaacacctggatttccacatggcgcggacgcccgagataggtctccagcagcagggaatcatcgccgaaggcggccttggcctcgcgcttggccgacgccaccgcctcggccagcccggacgcctcgctcaccacccgcatgcccttgccgccaccgccggcgctggctttgaccagcacgggatagccgatgatcgccgcctcgcgggtcagctcctccagcgtctggcccttgccgtgatagccgggcaccagcggcacgcccgccgcttccatcagccgcttggattcggccttggagcccatggcgtggatggcgcccaccggcgggccgatgaacaccacgcccgccttggcgcaggcctcggcgaaaccggcattctcggacaggaagccgtagccgggatggatggcctgggcccccgtcctcttggcggcttccaggatcacgtcgcccttcaggtagctctcggcggcggcggcggggccgatcagcaccgcctcgtcggccatggccacgtgcatggcgttggcgtcggcctcggaatagaccgccacggtgcgaatcccgaggcgcttggcggtgcgcatgacccggcaggcgatttcgccgcgattggcgatgaggatcttatcgaacatgcctctttatccctcaatccaagcgggtttgcgcttttccaggaaggcgcggatgccttccttgccctcgtcgctggcccggcgctcggcgatctggccggcggtccaggcccgcaaggactcgtccaggggctggtcggcggcgcggcggatcaggcccttggcggcgctcatggcctgcggcccgttgcccttgacgcgggccagccacttgtccctgacctcggccagatgctcggcggggacgacctcgtgcaccagcccggtggccttggcctcggccgcgtcgaacagttcggcggtgacggcgtagcgccgggcggcgcggccgcccatggcgcgcaccacataggggctgatcaccgccgggatgatgcccagcttgacctcggacaggcagaaggtcgcgccttccgccgcgacggccagatcgcagcaggccaccagcccgacgccgccgccataggcggcaccctgcaccacgccgatgacggggcgggggcaggcgtcgatggcttccagcatgtccgacagggcttgggcgtctgccaggttttcctcgtgggaatagcccgccatgcgcttcatccactccaggtcggccccggcggaaaagctttttcccgtggagtccagcaccacggcgcggatgcccggcgccgtggcggcgtcgcggaaggcggcggccagttcggcgatcagggcgtcatcgaaggcgttgtgccgctcggcccgattgagggtgatggtccgcacgccgtcatgggtggtgacgagaagggcgctcatgccgcttacatcctgaacacgccgaacttggtcggctcgatgggggcgttgaaggaggcggacagcgacagcgccagcaccatgcgggtctcggccggatcgaccagaccgtcgtcccacagccgcgccccggcgtaatagggatggccctgggtctcgtactggtcgcggatgggggccttgaaggcttcctcttcatccgccggccagctttgacccttggcctccatggcgtccttcttgatctgggccatgacgttggcggcctgctcgccgcccatcaccgagacgcgccccgtcggccacatatagagcatgcgcggctgataggcccggccgcacatgccgtaattgccggccccgaagctgccgcccatgatcaccgtgaagcgcggcaccttggcgcaggccacggcggtaaccatcttggcgccgtccttggcgatgccgccggcctcgtacttcttgccgatcatgaagccggtgatgttctgcaggaagatcagcggaatgccgcgctggctgcacagctcgacgaaatgggcgcccttctgggcgctttccgagaacaggatgccgttattggcgacgatgcccacgggatagccccagatatgggcgaagccgcagaccagggtggtgccgtaggtctgcttgaactcgtccaggcgcgagccgtcgacgatgcgggcgatgacctcgcgcacgtcatagggcttgcggcggtccttggggatgatgccgtagatttccttggggtcgtacagcggctcttccggcgtggccattttcaggctggtgggcttgatgcggttgaggttgccgacgatgcgccgggcgatggccagcgcatggccgtcgtcctgggcgtaatggtcggtgacgcccgaggtgcggcaatggacgtcggcgccgcccagttcctcggccgagaccacctcgccggtggcggccttcaccaaaggcgggccgccgaggaagatggtgccctggttcttgacgatgacgctttcgtcgctcatggccgggatataggcgccgcccgccgtgcacgagccatgcaccacggaaatctgcgggatgccaagggccgacatctgggcctggttatagaagatgcggccgaaatggtcgcggtcggggaacacctcgtcctggttgggcaggttggcgccgcccgattccaccaggtagacacagggcagattgttctccttggcgatgtcctgggcgcgcaggtgcttcttgacggtcaggggatagtaagacccgcccttcaccgtgccgtcattggcgacgatcatgcattcctggccgttgatggagccgatgccagtgatgatgccggcccccatcacgtccttggaatacatgtcccaggcggccaattgcgagaattccaggaagggcgagcccacgtccagcaggcggcggatgcgttccctgggcaacagcttgccgcgggcgatgtggcgctcgcgcatggcggggccgccgcccatcttgacctgggccaccaccttcttgaggtcgtccaccagaccttgcgtggcctcggcattggccttgaactcgtccgagcggggattgatcgaggatttgatgacagtcatttggttcgtccctggggcctgcgcctcgtcatccgctgtcttgtcatcccgaacgcagtgagggatctccgtctactccggcatgtccggtttcccgtggccgtgccaggaggagatccctcgctctcgctcgggatgacagtttcacgggagctacttggtttcttcgaacagctcgcggccgatcagcatgcggcggatctcggatgtgcccgcgccgatctcgtagagcttggcgtcgcgcagcagccgcccggtggcgtattcgttgatatagccgttgccgcccagggtctggatggcttccagcgccatccaggtggccttctcggcgccgtagaggatcacgccggcggcgtccttgcgcgaggtctcgccccggtcgcaggccttggccaccgcgtaggtgtaggcgcggcaggcgttgaaggtggtgtacatgtcggccagcttgccctgcatcagctggaaggtgccgatgggctggccgaactgggtgcgctcgtgaacataggggaccaccacatccatgcaggcggccatgatgccaagcggtccgccggtcagcaccacgcgctcgtagtccaggccgctcatcaggacgttgacgcccttgcccacggcgcccagcacgttctcttccggcacttcacaatcctggaacaccagctcgccggtgttggagccgcgcatgcccagcttgtccagcttctgcgccaccgagaagcccttgaaagtcttctccaccaggaaggcggtgatgccacgcggtccggcggtgacgtcggtcttggcatagaccacgatcacgtcggcgtcggggccgttggtgatccacatcttggtgccgttgaggacgtagcggtcgcccttcttctcggccttcagcttcatggagaccacgtcggagccggcattgggctcgctcatggccagggcgccgatatattcgcccgagatcagcttgggcaggtacttcatcttttgcgcttcggtgccgttgcgcttgatctggttgacgcagaggttggagtgcgcgccgtaggacaggcccaccgaggccgaggcccggctgatctcctccatggccaccacgtgctccaggtaacccatgccggcgccgccgtacttctcgtcgacggtgatgcccagcaggcccatggcgcccaggcgcggccaaagctcgttggggaattcgttgctgcggtcgatctcggcggcgcggggggcgatttcggtggcggcgaaggcggcgaccgagtcgcgcatcatgtcggcggtctcacccagatcgaagttcagcgcggaattgaagccggtcatgctcgttccctcatacagcccggttggtgcgttaaacgagcatacgtttttttaattcggccgcaaggggattcaaccggctcccagcaccatcagccacaaaggcagaatcaccgctccggcgatggtctgggccgacagcatggtggccaccagggcggcgtcgccgcccatccggcgggcggtgacgtaggaggcgggcgaggcgggcagggcggcgtagatgccgcaggcccccaggatggcgccacccagcccggcggctttcagcgcgccataggccagcaggggcaggacgaccatcttggccgcgatggccagccacaccgacggggcgggttgccgcaggctctccaggcggatgccggcgccgatggccagcagtgccaaaggcagcgaggcgccgcccaggatgtcgaggatggaggcggccaccgggggcaggcgcaggcccgagaggttgatggcggcgcccacggcgcaggacaggatcagcgggttggtgatcaccggcaacaccgcctcgcgccagcccagcctcccgtccgtccgcgcccaatgcagcatggccagggtggacagcagattgaccagggggatcacggcggcggtgcagacggcgatcagcgccacgccctggctgccccacagcccggctcctaccgccagggccacataggtgttggggcggatcacgcattggaacaaggaggtgaaggcggggccatccagggaccacggcggctgttccagccgccgcgccgccagaccggccgtcgcggccatcaccaccaccagccccgcctcgacggcgaagatggtgcccaccggcagcccctccaggcgggcgcgggccagcgaggcgaccagcaaggcggggaggaacaggtgaaaggtggcccattccgccggcgcccagaaggcatcgtcgacccagcccctcgaccgcatctgatgccccagaatgatcagcgcgatgatcggcgccagggccgagagaacctggatcattccaccccgtgatccgccaaactggacctggcgtcggccaggtcgtcgcccagttcgcggatggtggccagcagcgactggatcagggtgttcagccccggcggcgcctgatccatcatggtgcggatggcctccttggtcagcaccaggcaggtggcgtcgtcatccaccagggcggtggccatgcgcgggctgtcgtccagcagggccatctcgccgaacacctggaacggccagacccggccgatggtgatcttgcgtccggccgtggtcttgaagatgcgcacggtgccctgctgcagcagataggcctcgtgcccggtgtcgccctccttgaagatgaccgtgccccgggggaaaacgcgctgaagtccgggtgtgccggcggtgtcgctcatggcggatcccttcgccccaaatggaaaggacggccagcatagcgcgggcatcccgcttctccaatcgggtaaggggcggggatggaaacgatgtcacgatacctgcggttgccagtgagggtggggtcgcggtacccttgggcaaaacaatggcggaaaccgtcatctcagggagaaacgctcatgggaaaaccccatcggattgcactggccttgcagggcggcggtgtgcacggcgcctttacctggggcgtgcttgacgccctgctggacgaggctgcggccggcaatatcgaattcgtcggcgtgagcggagcctcgtcgggggcgctgaccgcgacggccatggtctatggctatcacgagggcgccgcccagcccgggccggccagcgcccgctcccggcgcatggccgaggcggcacggaccaagatccgcgagttgtgggagacggtggcccgggccgccttctggggcggcaaccccttcgtcgccgccatcgggctggccccgggctggaacatcgacgatacccccgcggctcgctgggccgacgtggccggcggcaatactccggcggcggaatcggggctcgccacctatctcaccgcggtgctgcgcgacgtgctgcccgagattccggccatcttcgccttgccgcaggaggcgacccccaccctgatcgtcgccgccaccgatatcggcgagtgccgccgccagttgttcatcgacggcgcggtgtcgcccgacgcggtgcgggcgtccaccaacctgcccacctcgctgcacaccgtcaccatcggcgatcaccattactgggacggcggctatatgggcaatccgccgctgacgccgctggtggagcggctgcgcgaggccgacgccgccgacctgctgctggtgacgctgaatccgctgcaccgcgacggcccgccgcccaagggggcgcgtcaggtgctggaccgcctcaacgaggtggccttcaacgcctcgctggtccacgaggtcaacgccatcgagaccatcaaccggctggtggacgccggcatgatcaaggatccgccgcccggccagcatccctatcgccgggtcaacctgcaccgcatccacgcggacgaggccatggtcaagctgggcgtctattccaaggatgccccggcctgggatttcctggtctatctccgcgacctggggcgccaggccttcaccgattcgtgggcgaccatcaagccggcgctgggcaagcggtcgtcgtgggacaccaattcggtgtgcgatcaggtcctggccagaaaggcgatcaccagccgggagaaatagcctcatccgcccttgaccgattgcatgcaaccggccactctgcacgccatggacgagggcaaaaggcaactttcagccgctgaacggttcgactggctgcggctgatccgcagcgagaatgtggggccgcgtaccttctcgcgcctgctggaacgcttcggctcggccagcgccgccctggcagctctgcccgacctggcccgcaagggcggcgcccgccgccccatccgcatctgccccaaggccgacgccgagcgcgagatggaggccaccgggcgggtcggcgcccgtctgctcggcgttgccgagccgggctatcccgcctggctggcggcgctcgacgatgcgccgccgctgctctgcgtgctgggcaatccgtcggtgctggccaagcccatggtggccatggtcggcgcccgcaacgcttcgctcaacggccgcaacttcgcccgccggctggccgccgacctgggccgggccggctatgtggtggccagcggcatggcgcgcggcatcgataccgccgcccatcagggggcgctggcctcgggcacggtggcggtgctggccggcggcgtcgacgtggtctatccccccgagaacaccgatctgtggcgggaaatcggcgcggccggcgcggtggtgtcggaaatgccggtggggacccagccccaggccagctactttccccgccgcaaccgcatcatctccggcctgtcgctgggcgtggtggtggtggaggccaatgcccgctcgggctcgctgatcacggcgcgcttcgccgccgaccaggggcgcgaggtgttcgccgtgccgggctcgcccatggacccgcgtgccgccggtcccaacgatctgctgcgccacggcgccaccctgaccgaaagcgttgccgacgtgaccgacgtcctgggcgacctgctgcgccggcccctggccgagggcaaacgcgccgatttccgcgctccccagccggttgaacccgatacttccgagatggaccaggcccgcgcccgggtggccgaggcgttgggtcccgcaccggtgatggttgacgaaatcatccgccaatgccaattgtcaccctccatggtgtcctgggtcctgctggagattgaactggcggggcgtttggagcgccatcccggcaatcgggtctcgctgctggtcggctgagattccttgcccccaggatgtgatcgggtgcggatgaaagtcgtcgtcgtcgagtctccggccaaggccaagaccatcaataagtatctgggcagcgacttccacgtgctcgcctcctatggccatatccgcgaccttccgcccaaggacggatcggtgcggcccgacgagggcttcgccatggactgggagaccgatcccaagtccgagcgccagatcaaggagatcgtggccgccgtcaagggcgccgacaaactgttcctcgccaccgacccggatcgcgagggagaggccatctcgtggcatgtgcgccaggtgctggaagcccgcaaggcgctgaagggcgtcgaggtcaagcgcgtggtgttcaacgagatcaccaaatccgccgtgctcgacgccatgcgcaatccccgcgaaatccatcaggaactggtggacgcctatctggcccggcgggcgctggattatctggtgggcttcaccctgtcgccggtgctgtggcgcaagctgccgggctcacgctcggcgggccgggtccagtcggtggcgctgcgcctgatctgcgagcgcgagtccgagatcgaaagcttcaagccccgcgaatactggaccatcgccgccgacttcctgacccccaagggggcgctgctgtcggcggggctgacccatctgggcggcaagaagctcgacaagttcgacctgtcctccgaggccttggcccgcgacgccgagagcaaggcggcgtcggcccgctatgcggttgccgcggtggagcgcaagcggacccggcgcaatccctacccgcccttcaccacctcgaccctgcagcaggaagccagccgcaagctgtacttcgccgcggcgcgcaccatgcaactggcccagcgcctgtatgagggcgtcgatatcggcggcgagacggtgggtctcatcacctatatgcgaaccgacggcgtgcagatggccgccgaggccatcgccggcgcccgggcggtgatcgcccaggatttcggcaaggtctatgtgcccgaggcgccgcgcgtctacaagaccaaggccaagaacgcccaggaagcccacgaggccatccgtcccaccgatctggcgcggcgtcccgaggacgtggcccgctatctcgacaaggaccagctgcgcctgtacgagctgatctggaagcgtaccctggccagccagatggccgccgccgagctggatcaggtgggcgtcgacatcgccggcgaccagcacggcatcgtcttccgcgccaccggttcggtggtggtgttcgacggcttcctgaaggtctaccgcgaggacaaggacgattccgacgacgaggatgcggaaaagctgctgccggacgtgaccgagaaagacgccatggaccgcaaggccatgcgcaccgagcagcacttcacccagccgccgccgcgcttctccgaagccagtctggtcaagcgcatggaagagctgggtatcggccgcccctccacctatgcctccatcctgtcggtgctgcaggagcgcaattacgtccgcctcgaccagcggcgcttcatccccgaggatcgcggccgtctggtcaccgccttcctggaaagcttcttcggccgctatgtggagtacaatttcacggccgatctggaaaaccagctggacgacgtctcgggcgggcgcgacgactggcgcaaggtgctcgaccggttctggcgcgacttctccggtgccgtggacgagaccaaggacctgcgcgtcgcccaggtcctcgacgccctggacgagcttttggggccgcacttcttccccgacaacgggacgggccacgatccgcgttcctgccccacctgcaatgccggacggctgtcgctgaagctgggcaagttcggcgccttcatcggctgctccgcctatcccgaatgccgcttcacccggccgctgaccaccggcggcgagggcgaggaagaggtgagggaaggtcccaaggaactgggcaacgacccggagagcggcctgccggtcacgctccgcaagggaccctacggccattacgtccagctgggcgacgagaccacgctcaaggccgagcccgcgccggtgccggaaaagggcaagaaggcccccaagaccgcaaaagcggtcaaggcccccaagcccaagcgggtctcgctctacaaggggctcgagccggccggcgtcaccctcgacatcgcctgccgcctgctggccctgccgcgtctggtcggcacccatcccgagacgggcaagtccatcagtgccggggtggggcgcttcggcccctatgtggtgcatgacggggtctacaaatcgctggccaaggacgacgacgtgctggtcatcggcatgaaccgcgccatggaattgctgtcccaggccaagggccgcggcggcagcggcccgctcaagaccctgggcgagcacgagggcaagccggtcaccctgcatgaagggcgctatggcccctacgtgtcccgcgacggcgtgcatgccaccctgcccaaggacagctcgatcgagacggtgaccctggaagccgccctggccctgatcgccgccaaggcggccaagggtccggccaagcccgtccgcggccgcaaggccgccgcccccaaggcggaggccgcgcccaagccggccgccgccaagaaggctccggcgaagaagaaggctcccaccaagaaaaaggtggcggccaagggctagtcccgcaggtctcgatcgagggcgatgtccgtccgggcgggtggattggttcccggcggggtcgtgttcgtgccgggaacagtgatggacatcggtccggcggcacatctgctgtggatgtgccgcgagatcaagtgatcacttaaagggtatcactgtgcagtcggcgtgattggctggcattttatttacaaatttccatgttttgtttttaggttttcacaaaatgtcgagttccccgtaaggttaataaaacctttactcggggatctgccatcacattgaagtgatgggcaaaaatccggttgcgcggacgctgccaattgttctagagtggtgctgttaggaagtgtgctccctgcatgcgacccgcagccagtggcttgccggttgcggggaatgtaaggaagcccggggcgagaatcgcaccggcctctctagaaaggagacttgttatgtctgacgtcacccttacttctgcggtccgcagcaacctgcttgcgctgcagtccacccaaggtctggtgaatcgtacccagagccgtctgtcgaccggtttgaaggtcggcagcgccatcgacgatccggtggcctacttccagtccaaggccctgtccgaccgcgccagcgacttccagggcaagaaggacaacatcgaccagggcgtttcgtccctgtccaccgctctgcagggcatttccggcgtttcgacgctggtgaagcagctcaagggtcttgcgctgaacgcgcagtccgcttcgagctcgcagatcggcagcctggtgcagcagttcaacgcgctgcgcagccagctggacaacctggctctcgatagccaataccagggccagaacctggtggcaggcaagggccagaccctgaccgtgagcttctccaacctgaccggctccaccctcgaggtgacctcggtcgacgtgcgcgtcggcgccaccggcctgaacatcgccaaggccgtgacctccaacggcggcttccagctgtccttcgatgacgcctccggcgccgcgctgggcaccgagggtgtggtcaaggccacctacgccggcaccgcgaccgcgctgacgtcgggtacctacaccttctcctacggctcggctacggtcagcttcaccgtctactcggcgggcggcaccaccggcgccaatgccgacgtcgaagccttcaccaccacctcggtgctggccaacggccaggacttcaatttccgcgccaccaccgccggcgacaccgacgagttgaacgtcacccagggcagcatccagaacaacaaccacttcgccgtcgagtatcatgcttcgaccggcggtggcgtgtccggtctggcgggtggcgacagcctgaacttcgtgatgaacggcctgaccggcaacagcctggcctcgggcaactatacgttctcgttcggcggctacaacatgaccttcaccgtggcgtccgccggtgatgtcaccgccggtacgttcaccaccaccaacaccttcgtcaacggcacgttcggcaccgccggcggcgtcaccgccaacaccctggcgctgaccctgtccaccggcaccggcaccaaggaaaacgtggtgaccttcaccgccgcggtctcctcgctgggcgcgacctccggcccgtacaaggggcaggcgtactacagcgccggcggcatttcgggtgcctatggcttccagatctcggccgagaccaaggtcggttacgtgtccggccagtacgtgctggactccaagctgaccggtgtggtgcagaacctggtcactcagctcgacgccaacctgcaggtcctgcgctctcacgctcagaacctgggtaccaacgtcgccctgctgaacacccgtctggacttcaccaagaactacgtggacctgctccagtccggctcgggcaagctgaccctggccgacctgaacgaggaaggcgccaacctgttggccctgcagacccgccagcagctgggcatccaggcgctgtccttcgccggtcagaacgaaaagtcgatcctgtcgctgttccgttaattcgaatggcgtagttttggggagaagaggtggctttgccacctcttctctttttttgtgggtgccgcatggttccccggcttggggagcgcatcgaacacggcggatcaggacggacatcatccgccgccccggccgtcggcggaggcagtcgagttatccccaggtgggaaaagggagtcgggcatggccgcagcgccgcagatcaacgcagaactggtgtccgcctatctcgaggccttcctcgaactgatgcccgaaatgggcgagcggctgcgtgtgcaccggcctcaaagcaatctggtggttaacgaggatggcgacctggatgtcgaatttcggggcgagttcctctacggtccgggcgggcgcaagcggatcgaggacatggccacccgcaccgcgctgggtcccgaccaccgcatctcggcggcgcccctgtccagcggccacgtggatctgatcgttaagcgctttctctacaacatcttgaagcgcgccacggattcgggcctctcgtttctccagcatcccgaggaatccggcggctttcacatggtctgcctcggcctcggcctcggctaccaattaccgatcctgctggagcaggacaatcccgccggcattcatatcgtcgagcccaatttcgacttcctctaccactcgctgtccaccgtcgattggcgtccgctgctcgagacccgtcgcgaaaatcccttgcggctgaacatcatcatcgaggaagagccggggcagatcgcccgccagttgcgctcggccatccgctgctgctgtcccatcgtggtggattggacccgcctgttcgtcgcctataacagcccgctgctgacggcggccatgtcggaattcatgcgcgacgcccagctgatcggcatcggcctgggctttctccacgacgaaatggagatgacgcgcgcctcgtacaaaaacatgcgcgacggccgctactccatcttgcagcactccgccacccagttgcacaccccggtgttcatcgtggggtccggtccctccatcgatgacgacatcgaggtgatcaaggccaatcaggaccgggccgtgatcatttcctgcggcaccgcctcgcgggttctgctggccaacggcattcagcctgatttccagatgctgctggaaaatggcgccgccccctaccgggcgctggcggcggtgcacgaggaattcggcttcggcagcgccacgctgatcggctccaacaccgtcgacccccgggtgcgcgacctgttcgaggacgtggtctactacttccgtccggcgctcagctcctatgcgctgttcagtccggggatagagtattccctggacgattccggtcccaccgtgaccaataccggcaccacggcggccctggccctgggctttcgcgagctttacctgttcggcgtcgacctgggcagccgcaaccccaagcgccaccattccaagcaatccctctaccgtcacgccgacgacaccaaggacggccagaagggagccatggatttcgacgcggtgttcgacgtccgcgagccgggcaatttcggcggcgtggtctatagcgagaccatcatgctgtggacccgtgacgccctggggcggatcatcgggcgctatcgcccggcggccaacgccttcaattgcagcgacggggtgatgatcgagaacacccgtcccctgagttcgcaatcgctgcgcctgaaatccacgccggatatgaaggccaaggacctggccaaggtccgcgcctcgttcaggccggggggcgaggaactgttccacgaccgctgggatcgcgaggactggccgcgcagcatcgtcacgctgctgggggaatgcgcccaggccatggacgatcatgtgggcgacagcaaccggctgatgctggtgctgtcggagatgctgctgcgcgattacaagcagccgcccaccgtggcccagttcttcgtgcgcggcacgttgatgatggcggccatgtgctacgactactatgtaaagcgggtcacgccggcggaccgcaaggccgagttctgggaaatcatccgcgacgagttccaccagatgattcgggtgatgaccctgcaggttgaatggtactttgacaacatcgaggcgttcgagtcggacgaggaactgttcgataaggtgacggggtgggattatgactgagagccggatcgacgaaatcaaggaactggtggatctgctccagaacggcacggccctggaactgatggaggtgtgccagaggaagatcgccgagggcagcctcaacccctattatttcatggtgatgggcgtcatttcctgttcaacggcgatgccggccttggcctgcagctggccgagcgggcgcacgccatcgaccccaattgccgcgaaatcgtggatgtcctggcctcgctctatacccgtgtcgggcgcctgaccgacgggctgtattacgccaagctggcggtctgcctgaagcccaaccccgaggcccagcccctggttccgccggacctggcctcctacgccgcctcgctggtgaatgtgggcgtgtcgcaccacctgaccaatgccgaggcggcgcttcacctgggtctgttcgacgaggcccgggaccagacggaaaagtatctgcgcattcatcccgaggatggcgagggcatggtgttggcggccaaggcgctgctggcgctgcagcgtccccacgccgcggcggccatgatgcgggccgcgcttcaccacgatccgcgcaatggctggatgcatgccctgctggccgaggcgctgatgggctgcgcccgccacgaggcggcattgtcgcaccagaagctcgccttcgagttggccggcgacgatgacgccctcagggggcgtctggccggctccctggcgctccaatccggtgcctgccggccggcggcccaaggcctgctcggcgccttgaacgacgagcgcgaagccccggtccgccgggtcaatgtccgcgagccgatcgagtcgatcatggtcggcattttgtgggatcaggtctatgacagtccgctggtccattgcgtcacgcccatttgccgtcgcttcgacatgtcggtgctgtacgtccgcaatgtccggcacgacgctgtcggcgacgtgctgcgcggtgcggtgctgcggccgcgtcaggcggtgggcgtcgacgacgccaccctgggccgcatcgtggtcggcgatcaggtggtcgccctgatcaatctttgcgccccctccgagatcgccaccttcccggtgttcaagggcgagggggcgccgatggtggtccactgggtcacctcgcccatgtgcgaccggattcccggcgccgacctcgtcctggccgatcccgagacggtggatgtggaccgccggacctatggcgaggagcgggtggcgctgctcagcaacctgctggcctttgaattcccccggattctggcaccggaagaggaggttctcgacctcccccgcgaaacacgcggctttgccatgttcggaatccacggcgtgtcggcccgcatgaccccggactcggtcgccctgtggtccaaggtcctgtgggcctgccccgaggcccatctgatgatcggtggccgtgacgactgggaagaggggatggtgacctgggccctggacgccttcgccgaatacggtgtctccacccgagttcacttccaggctccgctggagggcgaggggactttcgccgccgccaaggcttttccccacatggtcgatgtcatccttgattctacccccgtgggggcggaggtcgagacggtccatgacctgtggatggggcttccggtggtgtcgctgcgcggccccactcgggtcggtcgggtcggcacctcggtcctgcgtgcggcgggacgtcccgaatggatcgccgacgacgaggccggctacatccgtatcgccgccgccctggcgcatgatccggcgctgggggagacccgcaagggcctgcgggagcagatcctggggtcgcgccttgccgatcccgtcgccctgggcaacgagatcgcccagtgcctgatgcaggccctgaccgccagacggacgcaacgctgagatggcggaccccttcgccgccgcctttgctcggatcgaagccggagacttggacggggcggaggaggtctatcgtcaggcggtgcgcgacggggcgcaggacccgttgctgcgcatgtgcctgggccagcttctgatgctgcgcggtgattatcgccgtggcttgcccctcaacgagtttcggccgctgtcgcccgtggccggcacgcggtggcgggggcagccgctcaagggcgagacggtgctgatcctgggcgagcagggctttggcgacaacatccagttcgtccgctatgccgagcccctggcccggcgcggcgcccgcgtggtcgtcggatgccagaccggcatcggccggctgctgtccaccgcccccggcgtgtcgcaggtggtggaatccggccagggcatggaccggcccgatctggtcattcccctgatgtccctgccctatgtgttcggaaccacggttcagaccattccggcccgtgttccctatctgaccgccgagcccgctgccgtcgcagtctggcgggagcggctgtcgccctatgccgggctgaaggtcggattggtgtggggcggcaatcccgaggcggcctatgacgctcgccgctcgccggggcttgatccctatctcggtctgctggacctgccgggcgtcacgttcttcagtctgcagaaaggcccggccgccgccgccctggcggggcgaagcatgcccgccaatttcgtcgacctggggccggaactgaccgattttgaccagagcgcggcggtcatggaatccctggatctggtgatttcctcctgcacctcgccggcccatctggctggagccctgggccgtccggtctgggtggtgctggcgtcctttcccgactggcgctggctgctggagcgcgaggacagcccctggtatcccaccgcccgcctgttccgcgccggacgcggcgaaggctgggacccggtcctggggcgggtgcggacggccctggccgcgctggcggcgccgtctccctgatcaggccgtcttggcgtcggccgcgttcttctggccttcgagcaatccctcggccagttgcatgttgatgttgatcagggtgttcagcgccgaatcgccgatggacgcaccattggtgaaggtggtgtgggcgacgaattcactcagccggatcaggttggccttgaggtcgggcggcagggcgctgcccggcgagcgcgccagggagcggatggccacccagacctccaggttgtgattgagggccgccaccagctcggcggcgcggttttccccgctgcgggcgcggtccagggcgatggccgcctcggccaggctcagggcttcctgctccggcaggggaagggaggacaggtcaccgatttcttcggtcataggagactccgggttttcgccagccagcggatcatattgattcagcccgatattcttcgctcattccggttagaaaaccgttaacccccgccgggcgccggtcgggcgcgggccgggcgatttatggatttcttaacagaacggtgctaggctccactacgggtgacgaactcgcccaaatgcgtcggaggttattgtgaccgataccgtgctcagcgcctataccggcgatctcacacagatgctcagcacgctgtctggcatgtcggcgcggccgtcgttcaatctggccttcgccaacctccagaacgcctacgccaaccagtataatgacaagatgcagattctgcagcgtcaggcgctggaccgctatgatacctcgctggatgcggagctttccaagctggaagagcaactgcccaagctggaggcgtatcagaattcggtgtccagcaccgtcgccatggtcgccgagcgcatcgaccagatcggcgacctcgacgtgcagaacgcgtcgctgcagatgcacgcgggactgggcgagacggtggaccccacggagttcaataactccgtggacaacctgaacaatatgctgagccagcttcccaacaccgacgggacggagttttcgttctacggcgacgaaggcgtgggcgatatccgtctgaacggcgttggaatcaagcatttcaccgtcgatgacgagaacgccaagccgcccacgggttcaagcgtcgaactgtccaagggaatgtcctcggtcaatctgctgatcggccggttgtacaatcgcctcgacatggtggccggtgaatacgaccgggtccaggcccgcatctccgagatcaaggaccaccagcaggcccaggttgccgatatcaagaaggacgtggccaagcaggccaaggagatgaagctccagatcgcctcgcagcttcaggccctgtccgtcagcttcgaatcgcagcaggcctccaacgacaagatcatcaaggcccagaccaacgacacctatcagccggggtccgtggtcaatctgttttcatgagtcgatgggctcaccttcctgagaagtgatgggagaggttatgaatccttacagcaacgcagcccacgcagcgagttttccccaggaaggcaatccgagggaaacggaagcctgggcgctgaccgaggcggcgcgacgcatggcatcggcctcgcggggcgagcccgagggcatgcgggaatccctgcggctgaactggaagctctggaccattttccaggcggacctgatcggcaaggccgaggcgggcgaggccaccgaaaccgtggtcaacatgctgagcctgtgccagttcgtcgattttcacacggtcgccgccctgaccgagcccgatgccgccaagctcgaggttctggtcaacatcaaccgcaatatcgccagcggcctgcgtgattccctggcccgcgaggctcgtgaggccgccgaggccgccgggactcccgatcccgccgccgccgccgctccggccggcgcctatgctccggcgcccggtgtcgctcatacgcccatcagcgccaccgcctgatcgcggttctgatgcgtctttccgatccccggacacggcattgcgccaggtccggggatttttgattccaccggccccgttccgccatgacccgtccgtttccccccgtcctgctgttcgcggccgccgatccgggcggcgccaatgccgtgctgccggtggcgcggctgctggccgggcgcggcgcggcggtggcgatcctcgaccacggctttcttggccgcaatgccccgcccgaactggcccggatgccggttcccgcaggcggtgatctcggggcgtggccgcgccgcgccggaatcggcgggctctgcttcggcacctccctggccgaccggctccccctcgccctggcccgcaccgtccgggaagcggggatgccggtggtctgcgtcctcgacaactggatgaactaccgccggcggctcgaaatggatggcggtccctttctggcgccggacgtctacgcggtgatggatgacaaggcgcgcgacgaggccgtggccgagggcgtgccgccggcctgcctgcgggtaaccggccatcctgggctggcgggactggcccaggagatcgccgccgccgggccggactggcgccggcgagtgcgggcggaactggggctgggcggggcgggccgccagttgatcgccttcatcggcgaaccggtggcccgcgaccagggcaccggaccggaggttcccggctggcgtggctataccgagcgggatgtcctgcccctgctgtgcgggctgttgcaggaccgggccgagagcttggatgtggccgtggttccccatccacgcgacgacgtggcggagttggaggatctgtggcaaacatgccgtggccgtctcggcggcggcgtggttcgcggaatcggcgggcgccaggtggttctggccgccgaccgggtggcgggcatggcctcggttctgctctacgagggctggctgcagggcaagccggtgctcagccttcagccgggactggtccgtgccgatctggccgaggcggtgcggcggcccggcatcgggctggtgaccggcagcgaccgggcgccggaagcggtggccctgtggctgggggcgggacagggagaggcgcggcccgattgcctgcgccatggtgaggcgccggcccggctggcggatgtgatgcaacacttagcggaaagagcccatggcgaagcttgatcgagtggaagaggcgctgaccaaggcccggacgggtgatctgaccaaggccaggaccctgtcccgcgacctgggcaaggtgccccccggccatccctccctgatggagttgacggtggccgcccatcaggccggggaccttgtcctggcgctgaaatttctcgatcgggccgcggtctccggttccgccgacgccctgtatggccgcggcgtgatcctggccagcctggggcggctggacgaggcgcggacggccttcgccaagtgcctggaacgcttccccacccacgagccggccctgaccaatctgggcgggctggagcatctggccggcaatctggccgaggcggagcgctgctaccgcgccgttctcgatttcgccccccgctccgccctggccctgcacaacctcgccggcctgttcctggcccaggggcgccgcgacgaggccgaggcgtttgcccggcgcgccgtcgagatcgagcccggccccgataccgccctgcgtctggccgatatcctgggcgaggcgggccgccatgcagaggccgccgccatgctgggaccggttctcgacgcctatcccgccgatgtgcggctgtggcgggcggtgggccatgccgccaagaagcaggggcgcaccctggacgccgtggcggcctatcgcacggcgctcggcctcgaccccgaggacggggagtccagccacatggtggcggccctgaccggaaccaacaccgagcgcgccccggccgattacgtgcgcggcttcttcgacacctatgccgaccgcttcgaaagccatctggtggaggaggtgggctatcaggctcccgccaccctgcgcgccctgtacgagcgggtgggcggcggcgccatgctggacagcgtcctcgacctgggctgcggcaccgggctgaccgcccaggccttccagggaatcgcgggccgcgtcttcggcatcgacctgtcgccgcgcatgctgcaactggccggggccagcggtctttacgccggcctgcgcgaggccgacgccgccaccgccctggcccgcagcaccggcctcgcggcggtgctggccaccgacctgttcatctatgtgggcgacctggacgagatcttcgccggcgccgccagcgccctggcccccggcggctggttcctgttctcggtggaatcgggcgagggcgagggctacaccctgcgccccaccggccgctacgctcagtcgcccgcctatatccgcgccctgatcgcccggcatggcctggaggaggtggcgtgcgagcacggccgtatccgcggcggctcggacggcgatatcgacggcgattactgggcgatccgcaagccggtctgacgacgaaacgggtggcgggggcttcggccctcgcgctcccaccggatggcccccatgcggtgaacgagaacacaccacaaggcctgccttgcggcaatccttaggggctcgtcacgaaaagggggaatggggcgagtgatcggaatcgaaccgacgacatccagtaccacaaactggcgctctaaccaactgagctacacccgccaccgggggaggccgcatgtttagccaaatccgggggcgcccgtcaaggggctatcctttgaaataacgacgaagtcgcatcacggcctcatcaatggcgctttccgtcttggcgaagcagaagcgggcgaagtgatcgacgtcgccgccctggtagaaggtgctgattggaatggccgccacgccggccttttcggtgatgtggcggcagaagtcgtcgtcatcgccggcaaagcccagggggcggaaatcggcggtcaggaaatagctgccgccggccgccatcacctcgaagccgacgccgcgcaagccctcggccagccggtcgcgccgctcggccagcatggcggccagcccgtcgtaataggaatcctccttgtccaagccccaggccaccgccgactgcagattgggcggcgtggcgaaggtcaggtactggtgaaccttggccagtggggccagcaggtcgggggcggccaccacccagcccaccttccagccggtcagcgagaagatcttgccggccgagccgatcttcaggcagcgctcccgcatgcccggcagggtcatcagcggcagatggcggcgtccgtcatagaccagatgctcgtagacctcgtcgcagacgcaataggcgtcgaagcgctccagcagcccggcgacgaacgccatctcgtcccggctccagaccttgcccgacggattcatcggggtgttgaggatcatcagcttggtcctgggcgagaaggccgccgccagggtctcgcgcgggaggtcccaatggggcggctcgacccgcaccagcttcgggatgccgccggcccgccggatgatgggcaggtagctgtcgtaaagcggttcgatcagcaccacctcgtcgcccggctcgatcaggccgaacaggcagtcggccagcgcctcggtggcgcccgaggtcaccatcacctcggccatgggatccaattccgtgccatagaagcgccgctcgtgccgggcgatggcctggcgcaggtcgggagtccccatcatggacgggtactggttggggccggcgaccagggcctcggccgcccgggcgactacgtcggcgggctccagcccctcggggaagccttgaccgagattgacggcgccatgggcctgggccaggcgcgacatggtctcgaagatggtggtgccgagggatgagaagatggcgttggcgggcttcaacgggtctgctccagggcggaatcggaaggccccagcgtatcgcggaagcggtcggcgggtgaagagattgtgagctgcccaggaaataggcgtaaatgcctggaaatagggcatctttgccccgagattcctggggttttggcgcttttccgggtggccgaactggcacaatgcgtgctaaatgagtcgcgcgttttgacgcgggttctcaacgccaatgcgaaagacggcgggttcatgaagaagatcgaagccatcatcaagcccttcaagctggacgaggtgaaggaagcccttcacgaagtcggtctgcagggccttaccgtgaccgaggcgaagggtttcggtcggcagaaggggcataccgagctctatcgcggcgccgagtacgtggtggacttcctgcctaaggtcaagatcgagctggtcatcgaggacaatctggtggaacgcgccgtcgaggccatccagcaggccgcccacacggggcgcatcggcgacggcaagattttcatctccacggtggaagaagccatccgcatccgtaccggcgagcgcggcagcgacgccatctgaattttcgcccctcccgtcgcctccaaggggtggcggggcgggcgcgcgtgttcaactctcaactctcaggaatgtgaccatgtccgacgacgtcaagaaggtcctcgaactgatcaaggaaaacgacgtgaagtacgtcgatttccgcttcaccgatccgcgcggcaagtggcagcacaccgctcagcacgtgtccaccgtggacgccgacatgctgaacgaaggcatcatgttcgacggttcgtcgatcgccggctggaagagcatcaacgagtccgacatgatcctgaagcccgacgcttcgtcggccgtcatggaccccttcgcggctcagtcgcagctgatcatcaactgtgacatcgtcgagcccgccaccggccagctctacgaccgcgacccgcgctccatcgccaagcgcgccgaggcttatgtgaagtcctcgggcgtgggcgacgccacctatttcggccccgaggccgaattcttcgtgttcgatgacgtcaagtacgaactcggcatgaacaagggctactacgagctgcgctcggaagacggcgtcgaggcccagggccgcgacttcgccgagggcaacctgggccaccgcccgggcgtcaagggcggctacttccccgttccgccggtggacggccacgtggacatgcgcgccgagatgctgaccgtgatgggtgagatgggcctgcccatcgagaagcaccaccacgaagtggcctcgtcgcagcacgagctgggcatcaagttcggcagcctggtcgaggccgccgactggatccagatctacaagtacgtggtccacaacgtcgccgcctcctacggcaagaccgcgaccttcatgccgaagccgatctatggcgacaacggctcgggcatgcacgtccaccagtccatctggaaggccggcaagcccctgttcgccggttcgggctatgccgacctcagcgacaccgcgctgtactacatcggcggcatcatcaagcacgccaaggccatcaacgccttcaccaacccgctgaccaacagctacaagcgtctgatccccggcttcgaagccccggttctgctggcctactcggcccgcaaccgttcggcctcctgccgtatcccctactcggcctcgccgaagggcaagcgcgtcgaagtccgcttccccgaccccggcgcgaacccctacctggccttctcggccatgctgatggccggcctcgacggtatcgccaacaagatccaccccggcgatcccatggacaagaacctgtacgatctgccccccgaggagctgaagcaggttccgaccgtgtgcggcagcctgcgcgaagccctggaggccctgcgggccaacagcgacttcctgtgcaagggcgacgtgttctcgaaggaattcatcgagagctacatcgagctcaagtacgaggaagtgtatcgcttcgagcacaccccgcacccggtcgagttccagatgtactactcggtctaatccgagccgcatcaggtccgattgcgagcccccgccgggtcaccggcgggggtttttcgttggggcattgaaaagattggtgggcccggcaggactcgaacctgcaaccagaccgttatgagcggccggctctaaccattgagctacaggccccaccgggggcgaccataaccgaggcgcgtatgaatgcaagggggcagaggcccctttttcgcggctatgggcgatggaacggaggtttggaggcgagcctccaaccggggccgggcgggagcccgggaaatcgcgccagcgacggtccccctcccgttgaggggaggggggctggcaggctggataaatcaggtatccaggaacgagcgcagcttgcgcgagcgcgacgggtgcttgagcttgcggagcgccttggcctcgatctggcggatacgttcgcgggtgacgctgaactgctggccgacttcttccagggtgtggtcggtgttcatgccgatgccgaagcgcatgcgcagcacgcgctcctcgcggggcgtgaggctggccagcacgcgggtggtggtctcgcgcagattggcctggatggcggcgtccaacggcaggacggcgttcttgtcctcgatgaagtcgcccaggtggctgtcttcctcgtcgccgatgggggtttccagcgagatgggctccttggcgatcttcaggaccttgcggaccttctccagcggcatggacagcttttccgccagctcttccggggtcggctcgcggccgatctcgtgcagcatctggcgcgaggtgcggaccagcttgttgatggtctcgatcatgtgcaccggaatgcggatggtgcgggcctgatcggcgatggagcgggtgatggcctgacggatccaccaggtggcataggtggagaacttgtagccgcggcggtattcgaacttatccaccgccttcatcaggccgatattgccctcctggatcaggtcgaggaattgcaggccgcgattggtgtacttcttggcgatggagatcaccagacgcagattggcctcgatcatctccttcttggcgcggctggcctcgcgctcgccgcgctgcaccgtctggacgatgcggcggtattcgctgatgggcaggccggcttcggccgagatgtcggcgatggtggcgcggatgtcggcggcgtccttgccgtgacgggcgccgaaatccttccactgcttggagcgctgggtgacctgctcgatccagtttgggtccagctccgagccgtaataggcgtcgaggaagtcctggcgcttgacccggcagctttcggccaggcgcagcagacggccttcctgcatcatcaggcggcggttgaggccgttcagctgctcgaccagctgctcgatgcgggcgttgttgaggtggatgccatccatcaggcggacaagctcgagcttcagcttgtcgtacttcttctccatggcgggggtgaccgcctcgcccttgttcagggcggccaggcgctggtcctggaccttttccagcttgtggtgagtggcggcgatgacctcgaaggtttcgagcacgatgggcagcagctcggtttccatggcggccagcgagatggagttctcctcgccttcctcggcctcgccttcgccctcgacctcgggctcgccctcggcgccctcttccttctcaccttcctcgccctcggccttgggctcggcctcgccttccggcttggcttcggcggcgccggcgggggcggcctcctcgacgatgacgccctcggcttccacctcggccagttcctcgggctcggggtcggcgccataggtggcgtccaggtcgatgatgtcgcgcagcagcatcttgccctcgaccagggcgtcatgccagtcgaccacggcgcgcagcgtcagggggctttcgcagatgccgccgatcatcatctcgcggccggcttcgatgcgcttggcgatggcgatttcgccctcgcgcgacagcagttccaccgagcccatctcgcgcagatacatgcggaccgggtcgtcggtgcggcccaggtcttcctcgtccacgttgccggcgccggaatagccctcggtctcggtggtttcttcctcggcggcttcgggggtgttgtcctcgccttcctcgctctcgaccacgttgatgcccagttcggacagcatggccatggtgtcttcgatctgctcggacgacacctcctcgggcggcatggcggcgttcaactcgtcataggtgacgtagccgcgctccttgcccttggccaccatcttcttgacggcgacacccagggtgtcgagcagcgggccatccatcgcctcatcctggttttcggaaacttcggccgtattcgtcgatttggtcgccatgaaaaatgctgctccttcagggtcttgaccccgagcgacatcggacccgcccgatctcgcccctctctgaaatcaaagtcgtcagccgttcccggacgcttcgtcgtccagggcgctggccgtctgctgctgcttctttaccgcctcgaagcggctccacgacgcggcggtggggccttgggcgagttcggcgttggcttcgctcacgtcagccagcaggtccttcctggtgtaaagattgtagacgtgctcccagtgaatccgggcctcctcggtggaaaggtcgtcgcgcagtgcgcgtacccgcctttcgttggcgtcgagaagagagtccagaatctcggaatatccgtccgttctcaaataggtcgcgaggccgtccgcgtcaagatcgcgggcagccccaaggtgctttagaatcccgcgccgaagattgtcaagggtcttgtccgcaaaagtggtctcgcccagcctctcaccgatggaatccatcaggcggggatggtcgagaaccagggtcagcatcatccattcctgggcgccggcattggggcgcggcgggcgggggcggccgacgccgggcagcatgccgtcgggacctttcagcggcgcctggggatcggggcggaagcggccgaagcccttgccgcccatcttgccgccgccggcattggtccaggggcgcggtggcgggcggaacgactccttgatcttctggcggaaggtggcgaggtactggtagcgcaccgtctcgtcggcgatggaaaaggccttgtcggacagttccttctccagcagggcgcggcgctcgggggtgtccagcggccggtcctgggtcgccacgcgccaggccacctcgaccaggggctgggcggcgtccagcacggcggccatggcggcggggccacgggccttgatcagcgaatccgggtcctcgggggcgggcagggtggcgaagcgcagggactggccgggcttgaggatggggaaggcccgctccagtgcccgctccatggcccgctgtcccgccttgtcgccgtccaggcagaggatgggctcgggggcgaggcgccacagctcctcgatctgctgctcggtcaccgccgtgcccaggggggccaccgcgtaggcgaagcccgcctgatgcagggcgatgacgtccatatagccctcgaccaccaccacccggttcaactcgcgggccatctcgcgggcatgagccaggccgtagagggtctggcccttgtggaacagcggcgtgtcgggcgagttaaggtatttgggctggccgtcgcccagggtgcgggcgccaaagccgatcacccggccacgccggtcggtgatgggaaacatcacccggccgcggaaatagtcgaaggacgccccgctttccggctttttcaacaggcccgcctcgatcagcaggctttccgggcattccttgctcatcagcgccgatttgagggcttcgcgcgagtcgggggcgaaccctaggcggaagcgggcgatggtgtcgtcggacagcccccggttcttgagataggcgaagccgtcgcgtcccgccgggccgcgcagatgcttctcgaagaaagccgaggcggcttcgagggcgtcatgcagcgaggcgcggcgctgctcgcgcacccgctcctctgggctggccttgggaacctctatgccggcctcggccgccagcttctccaccgcctcggtgaaggacaggtgcccggccctcatctcgaagccgatggcatcaccatgggcgccgcagccaaagcagtgaaagaaccccttgtcctcgttgacggtgaacgacggggtcttctcgttatggaaggggcacaggccctgatgctcgcgccccttgcgcaccagcttgacgcgccgcgccaccaccgaggtgaccggaatgcgggcgcgcagctcgtcgaggaattgcggagggaaggccatggaggcttagaatccggtttatgtttgtccctcgccgggcgggtgcctgagcacccttggccgcggcctcagcggccgcaggtcgcgacatgcgtcatatttgacgcgtgccgctctaaagtcggtggccgatcccagatatatggggccggacccggggggatcagccccccaattccttcttcaccaccgcgccggccttggagaagtccatggtgccggcatggctggccttcagttccgccatgaccttgcccatgtccttgatgccgccggcgccggtggcggcgatggcggccttgacggcggcggtgatctccgcctcgttcatctgcttgggcaggaacgtctcgatgatggtgatttcatcggcttcctgcttggccagttcgggcctgttaccctgctcatagagcgagatgctttcccggcgctgcttgatcatggattgcagcatctggcggatctcgtcgtcaccgataccgtcggccagtcccttgggccgggctgcgatgtcgcggtccttcaatgccgccagaatcaggcggaccgtggagaccgtgcgggcatccttgcccagcatcgcggctttgagcgcgtcgttcaactgctggcgcagcatggtaccccccgtttgggaaagcgcacaggctactccaaatccctacggaaaggaagctcatcctgggaaacacagctttgaaaaaacacgtattttctctccccgtcgcaacgcttgactctgtcggcgcccgtcattataaggcgcggaatttacctgatgccgactgggtcgcgatgcggccccgcagccccgaaggtcttgcctgttcgcgagatgctccggcggccttctgcggcccaaaatcggcgaggggagccttaggctctctatgatactgtacctgcggccggagctcttccggcccgcgaacgcgacaaaggaccaccatgccgaaccaacacgggaccgcaccgaagcccagcagccaggtgccgacctttgatgcgccgcgccccccgggcgccaccggggccctggtcctggccgacggctccgtgctgtggggcaagggcatcggcgccaccggctccaacgtgggcgaagtggtgttcaccaccggcatgaccggctatcaggagacgctgaccgacccgtccttcgccggtcaggtcatcaccttcaccttcccccatgtgggcaatgtcggcaccaatgtcgaggatctggagaccaccactccggccgcccgcggcctgatcctgcgcgccgacatcaccgatcccgccaactggcgctcggccaagcacctggactcctggctgaaggccaacaatatcgtcggcctgtgcggcgtcgacacccgggcgctgacccggcgcatccgggcgaagggcgctcccaacggcgtcatcgtcaacgcccccgacggcgcgttcgatctgcccgccctgtggggcaaggccgccggctggcccggtctggagggcatggatctggcgcgtgacgtcacctgtgcccagacctattcctgggatgagaccgagtggtccctgcgcggcggctatggtcgtcaggcgaagccccgcttccacgtggtggccgtggatttcggcgccaagcgcaacatcctgcgctgcctggccgaaaccggctgcaaggtgaccgtgctgcccgccgaggccaccgccgagcaggtgttggcccttgagcccgacggcgtgttcctgtccaacggccccggcgatccggcggccaccggcacctatgccgtgcccatgatccagggcgtcatcaagtcgggcaagccgctattcggcatctgcctcggccatcagatgctgggtctggcgctgggcgccaagaccttcaagatggacaccggccaccgcggcgccaaccatccggtcaaggacctggagaccggcaaggtggagatcaccagccagaaccacggcttcgtggtggacgaaaagtccctgccagccggtgtcaaggtcacccaccgctcgctgtttgacggctcggtggaaggcattgccgtggacggcaagccggtgttcagcgtccagtaccaccccgaggccagccccggcccccaggacgcccattacctgttcgagcgcttcgtgggcttgatggagaagcggggctaacagccccgtttttctcaaggtcccgcaccaaagattttttcagaaaagaaacgccgccatgcccaaacgtacagacatcaagtccatcctcatcatcggcgccggtccgatcgtcatcggacaggcctgcgagttcgactattccggcgtgcaggcgtgcaaggcgctgaaggacgagggttaccgggtcatcctggtcaactccaatccggcgaccatcatgaccgaccccggtctggccgacgccacctatatcgagccgatcacccccgagatcgtcgccaagatcatcgagaaggagcgtcccgacgccctgctgcccaccatgggcggccagacggcgctgaacaccgccatgaagctggcggatatgggcattctcgagaagttcggcgtcgagatgattgccgccaagcgcgacgtgatcgccaaggccgaggaccggctgctgttccgcgacgccatggacaagatcggtctagaaagcccgaagtcgcgcatggtcaagaccctgcaggaagcccgcgaggcgctggacttcgtcggcctgcccgccatcatccgccccagcttcaccctggccggcaccggcggcggcatcgcctacaacgtggcggagtacgagcacatcgtctcgggcggcttggccgcctctcccgtgcacgaggtcctggtcgaggaatcggtgctcggctggaaggaatacgagatggaggttgtccgcgacaagaaggacaactgcatcatcatctgctccatcgagaacgtcgatcccatgggcgtgcataccggtgactccatcaccgtcgctccggccctgacgctgaccgacaaggaataccagatcatgcgcaacgcctcgctggcggtgctgcgcgagatcggggtggataccggcggctccaacgtgcagttcgcggtgaaccccaaggacggccgcatgaccgtcatcgagatgaatccgcgcgtgtcgcgctcctcggccctggcgtccaaggccaccggcttccccatcgccaaggtggcggccaagctggcggtgggctacaccctggacgagctgaccaacgacatcaccggctgcaccccggcgtcgttcgagccgaccatcgactacgtggtcaccaagattccgcgcttcaccttcgagaagttccccggcgccgatcccaacctcaccacctccatgaagtcggtgggcgaggccatggccatcggccgcaccttccaggaatccctccagaagggcctgcggagcatggagaccggcctgaccggtctggacgaggtggagatccccggcgccggcgccggcgacatgaaggacgcggtgaagtcggccctggcccagccgcgccatgaccgcctgctggtcatcgcccaggccttccgcttcggcctcaccatcgacgaggtccacgccgcctgcttctacgacaagtggttcctggcccagctcaagggcatcgtcgacgccgaggccgagatcagggccaagggcctgcccatcgacgcccccggcctgctgcgcctgaagaagatgggcttctccgaccagcgtctggccaagctgtccggcaagtccctggtggagaccgctttccgccgcgaggtgctgaacgtcaagccggtgttcaagcgcatcgacacctgcgccgccgagttcccgtcctccaccgcctacatgtattcgtgctacgagggcgacggcgtcaacccgcccgaatgcgaatccgatccttccgatcgggacaaggtgatcatcctgggcggcggtcccaaccgcatcggccagggcatcgagttcgactattgctgcgtccatgccgcctacgccctcgacgaggccggcaaggagaccatcatggtcaactgcaaccccgagacggtgtccaccgattacgacacctcggaccgcctgtatttcgagccgctgaccgccgagacggtgatcgacctggtccgcaaggagcagtccaacggcaaggtcctgggctgcatcgtccagttcggcggccagacgccgctgaagctggctcatgcgctggagcaggccggcatccccatcctgggcaccagcccggattccatcgatctggccgaggatcgcgagcgcttccagaagatgctccaccagttggggctgaagcagccggccaacggcaccgcccgctccctggaagaggccatcaaggtggccgagaagatcggctatcccgtggtgatccgccccagcttcgtgctgggcggccgcgccatgcagatcgtctacgaccacgaggctctcgagcgctacatggtcgaggcggtcaaggtctcgggcgatgatccggtgctgatcgattattacctgaaggacgccatcgaggtggacgtcgacgccctgtgcgacggcaatcaggtctatgtggccggcatcatgcagcacatcgaggaagcgggaatccattcgggcgattccgcctgctcgctgccgccctactcgctggacaaggccaccatcgccgagctggagcgccagacggcggccatggccaaggccttgaacgtggtcgggctgatgaactgccagtacgccatcaaggacggcgacatctacatcctggaagtcaatccccgcgcgtcccgcaccgtgcccttcgtggccaaggccaccggcgtgcccatcgccaagatcgcggcgcgtgtcatggcgggtgagaccctggcctcgttcggcctgtcgacccgtcccgagttgaagcacgtggcggtgaaggaggcggtgttccccttcgcccgcttccccggcgtcgacattctgctggggccggagatgaagtccaccggcgaggtcatgggcatcgattccgacttcgcccgcgccttcgccaagagccagctgggagccggcaccaacctgccgaccgagggcggggccttcatctcggtgcgcgacggcgacaagccggccatggtcgagatcgcccggcgcctgctggagatgggcttcaaggtcatggccaccgacggcaccgccttctacctgaaggaccggggcgtcaccggcgtcaccatcgtcaacaaggtgctggaaggccgcccccattgcgtcgacgccatgatgaacggccaggtgcaactggtggtcaacaccaccgagggcagccaggcggtgaaggacagcttctccatccgccgcacggcgctgaccaacaacattccccactacaccacggtggccggagcacgcgccgcggtggaggccatcgaggccatgcgttgcggcacgcttgatgtggcgccgctgcaatcgtactttaaaggctcgttttaggggcgtaggggcgttcgatggaaaaaatcccgatgactccggctggcctggcccagttggaggaagagcttaggaccctcaaatatgtcgagcgccaggcggtgatccgcgccatcgccgaggcgcgcgagcatggcgacctgtccgagaacgccgagtaccacgcggcgcgcgagcgccagagcttcatcgagggccgggtctccgagctggaggacatcatctcccgcgcccaggtgatcgacatcgccagcctgtcgggcgatcaggtgcgctttggcgccaccgtcaccctggccgacgaggataccgacgacgaggtggtctacaccatcgtcggcgcccatgaggccgacatcaagtcggggcgcatgtcggtgcactcgcccctggcgcgtgccctgatcggcaagcatctgggcgacacggtagaggtcaccgcccccggcggctccaagtcctacgaaatcgtcgacgtccggttcggctgaggcgagggggccatgggcgaggtccacggctcctgtcactgcggcgccgtccatgtctcttacgcctcggacggtcccttggccgggcgtcgctgcggctgcggcttctgccgccgccacggcagcctctacacctcggaccctgccggtcggctacggatcgaggcggtagggggggcgctcagtcgctatcgcttcggccagcgcaccgccgatttcctgctctgcgcccgttgcggcgtgctggtggcggtcaccgccgaaattgacggcactttgcgcggcggagtcaatctcgccgtcatggacccgcccgtgcctgcggccgccgacgtgccggtgatgaatttcgatgccgagaccgaatccgaacgcaccgcccgccggcgccgcaactggatcggccatgtagagatcagagaggctcaaccatgacccagccccaatcggccatctgcgcggaaggcggtgatttcggtctgttcctcaccctggtgctggccgatggcgacaccgccgccgtgcggcgcgtcctggcggcgctgcccgacatgaccgagtccgtggccgtccagtcgggcgagccggccctgaccagttcggtggccatcggcgccgcctgctggcctcgactgaccggtcgggaatgcccggacgggctggtgcccttcgcccccctggccgatggcgcccgcaaggcccccgccacgccggccgacctgttcctccacatccactcgccccgccacgacgccaatctgatgctggcgcgccgggtggcgggcgccctgggaaatcatgtgcgggtggtggaggaagtcatgggctttcgccatctgggcaagcgcgacctgaccggcttcgtggacggcaccgagaacccggaaggcgacgatcgcaccgaggtggccctggtcaaggacgatcccttcgccggcggcagcttcgtctcgctgcagcgctacgtccacgatctgccccgttgggaggctctgtcgctgcctgaccaggaggcggcggtgggtcgcaccaaggattccgacgaggaaatggaggtcaagccgcccttcgcccacatcgcccgcgtggtgatcgaggaggatggcgaggagctggaggtgctgcgccattccatgccctatggcaccacctcggagaacggcctgtacttcgtcgcctactgcgccagtcccgctcccttccgcaagatgctggaacgcatggtgctgtcggcgggggacggccaccacgaccggctgctggacttcacgcggccggtgacgggcgccgcgttcttcgcgccctctgcggactggctgcgcgccctcgattgaggcacatgacccaagtcaagccgcttgcggcccgcctgggctaggctgcccgccgtgattgcctggggagatgtcatgaagcgcgcggttccgctggtcctgctgttgttgtcgtccacgtcggccctggcggccggggcggggatggagacgcgcaattacgtggcgcgccgtctgaccgccgacagtcatgtgcaggtggaggtggggggcgtcgagctttccggcccggtctgccgtgtctccggcaccgtgcgcaaggtctttgccggcgccctggcggcgggtgacgccctggcgttccggctgccttgcggcccggcggatttctggcctttggaccggctgaaatccgcccgtgtggccgaagtctttctcaagtcggggctgaacggcgccgaagccgccgatgacggcgaggggctgcgcgccatcgcggcggtgaccgcccagccgcaatcggtggacgatcccgccctggtgcgcgagatgaccgaatccatcgcccgctaccgcatcgatgccgaggtcaagcgccgcaatcccgccgccgccctgaccctggcgcgggtgcccgacccggtgttgcgtgcccgcctgctggcccatgccgccgggctgatgagcgtgcaccgcctgcccgaggccgaggcgaccggcgacgaggccatggcggcggtcaaggccctgcccgatgccgaggtgcggctggagtccggcctggtggcgctggaatccctggccatggggcaggcgcgcaaggcggcgctgaccctggccgacgcgctggagcccgacgtggacgccctgaccctgccgtcgcggcgcgacgccgccagtctggtgctgtatggcgcccgcatccgctcggacgatcccgcagcggccttcgtctccctgtccaaggtgaccgatccggccacccggcgcgaccgcctgtccaacatgcccttcgcccagaaggatttcagcccggtcaacccggactccctgggctggatggaccgcctgctggcgggggccgaggccctgccggccagcgacttccgcaccgaggccctgacccagctttgccgcaccgcccagcgttccgccatggagatggccaagatgcccaatctgctgggcaaggccggggccatggccgaggtggcggcccggcgtcgccatgggccgtcggcccaattgctggcgctgatccgcgaggccgagggcggcgcggcggcacgggccgaggcggcgcgctggcatgcggtatcggcgtccggcttcgatggcgccatgaagtcgcgggccgaggccctgacggctctgggcacctttaccccggccgagcgctctgccgccgcccgcctgcttcagccctcggccacgggagatgtctcgcccgcccgactggtggagatggcggcgaacgctacctctcgatgaacgcgactcggacggatccagctaggcccaaggggccgcgccgcttatgcggcgggagccaagggcgctcgcgcccgcccggcgattgaggggcatggtggaaaaaagctactcggcgggcaacaggacatgcaggcgggtttcgccgtcaccggtggtttcggcccacatgctgccgccgtgcaactggacgatcttgcggcagatggccaggctgagcgtcgggttgccaccccgcgtcgggctgctgccgggggccagcagcgggaacgaggtctcgccctcgccgaaatcgatgtcggtgttgtcggcgcggatcagcagatgccacatctcgccgtcgcgttcggcgctcaggccaatcttctgataggtgtcggggcgccggcgctccaggatggccgagatcaggtggtggaacagtcccgacagatgctggcggtctcccatgatctcgggcagatcgcgggcccggatctcggcctcggcggcggcgaggcgcggttccagcaggtctatggtctcggccaggacccgcggcagggacacgggctcgtgggggcggcactgcgccacgccgagatagcgctgcagggcgttcaactgagcccgcatgcgctcgatgcccgagcggatgaagcccagataatcgtccacctcggaattgccgtcgggggcggtcttgcgcaccagcaattgggcgtaggacagcacggtgcggagcggctcctgcaggtgatgggccgagatctcggcgatgtggcgcagttcctcgttggccagttccaggtcggcgctgcgccgggccagcaggcgctcgaagcgctcgcgggccaccaattggcgatgcatggcccaggtgatggccgccgccgccagaaccaggggaatggcgatggtcagcaaggtggtggcatagccctcccattgcatcatggtgtcgtcatgcagggtggagaccgagaccaccaccggaacgtcgcccaggcgccggtagctggcctggcgcaatttgccgtcggtggccactacgctggtgtagctgccggtcggggcctggggcagatgctccttgaacagcgggccctgggagaagtccttgcccatcagcccttcgtcgaaaggcccccggctcagcagagtgccgtcggcgttgaacagggcgacggtgccgttgggtctttgccggatggaatcgaacagctcgttcatgtggtccagttggatcatcagggcgatgaccgccaccagcctgccgtcggggcttcggtgggcctggctgactggcaggacccgcttgccgttgacccgactgatgataggcttgccgatgacgaggctgctttcgcccgccaggtgggcctggacgtagtcacgatcggcgaccgaggtgccctcgggcggtatttcgggataggaatgcaggtaatgccctccgggcgtgatgacccggatggccgtcaccgtggaggcgtgccgcagcacgttggccaggaatccgccaaagaccgggtcatgggcggaaaggccgcgctgatggtcgaggcgctcgctcaccagggaaaggaccatggccgattgtcggaacatgccgcccgtatgctcggccagggtatcggccagccgctcattgttgacctgacggtcatgcagaaggtcggcccgcctttgccacgccatggcgctgaaggttgcaaggacgaacagtacggccagaacacccatcaccaaggcactggtgctggcccgtaagacgggtctcttggtagcgccgttcggcatagtcgtcttctacccatttggcagggcggcatcatagcagccgattggtggggatcaatatctcatgccgtgcatatgcatggagtgcttgtggcaatagatgcaggctcctggcaccttgcctcgccggtcctctccatgccatcgtttgcccagaacaattgtggggaaaccatattggccgaggatttcgccaaggctgtcgaactgcatcaggcgggcaggctgctggaggccgtggagatctaccagcggattctggtggccaatccctacgacgagggggccaaccatctgcttggcgtggcctgctcccagatgggccagttcgatctggccattcacctgatcggcgaggcgatccgcgccaacgaccgggtgcccgattaccacgtcaatctgggcaacgcgctgttcagctcgcggcgcctgcccgaggccgaggccgcctatcgccgcgccctgaccctgaataccgacatccccgaggcgctgttcggcctgggcaataccctggcccagaccggccggctggaagagtccctggagttccatcagagcgccctggccctgcggcccaatttcgtcgaggccctggccaacatggccggagtactgagccgcctgggccgcccggccgaagcggtggaaaagctgcgccgcgccgtggcggaacggccgggcgaggccagcctgcaggccgatctggggcgcgccctgctggcgtccggtcatcgcatcgaggctgatgtcgccgtctgccgcgccctgcggctggcgcccgattcccctcccatcctggtggcggccgccgacgtgatccgggccaggggccggatggaagaggcgctggagcatgccgcccgcgccgccgagctggcgcccaattacccgcccgccgtcctgatgcttgcccgccagttgcgggccatggggcgccgggatctttcggccgagacctatctgcggctggcgggcatcgaaggcgccggagtggcccatctgttcgatgccgccaacgctctgaacgagatgagccgtctgcccgaggcggtggcgctgtatcaggcgctgctggcccgcgagcacgaccactccgaggtgtggaacaatctgggcaatgccctgcgggaactgggcgagttggaccgtgccgccgagtgctacgagacggccgagcggctcagccccgacgatcccgtggtcatgtccaaccgggccgccctgctgggcagcctgggccgggtggccgaggcagaaatcctgtgccgcaaggtggtggccctgcagccgggaatcggcattccgctgtccaatctcggccaggccctctacgcccaggggcgcatggaggaggcccgcgagcagttcgacgcggccggagcggccgattccaccaatgacgacatccgctttcaccgcgccatcgtccggctgatgctgggtgacttcgccgagggctggccgctttacgaggcccgctggggcaaccgcaagcgggccgagcccaatcgccatttcgccacgccgcaatggctgggcgacgaggatctggcgggcaagaccctgttgctgtggtccgagcaggggttcggcgacacgctgcaattcgtgcgcttcgcgcccctggcgacggcccgtggcgcccgggtgatcctggaggtgcagcctgccctggtttccctgctgcgtggcatgccggggattgcccaggtggtggcggtgggcgacgacaccgggccggtggacctgcaatcgccgttgatgagcctgcccatggccttcggcatcaccctggagagtattcccgccgccgttccctacctggctccgccgcccgagcgtctggagccctggacccggcggctgaacgccagccttccgcccggcccccgcatcgggttggtctgggcgggggattcccgcgagcacgacatcgaatgcacgctgatcgaccgccgccgctcgctggccttgaagcagctggagcccatcctcgcggtggaagaggccagcttcgtcagcctgcaggtgggcaagcagggacttcaggcccgggatgagccgcgcgtcgccgacctgaccgcgggcatcaccgacttcgccgacaccgccgcgctgatcagcggtctcgatctggtgatcagcgtcgacacctcgaccgcccatctggccgccgccctgggtaagccggtctggttgctgtcgcgcttcgacggctgctggcgctggcttcagggccgcgacgacagcccgtggtatccgacgctccgcctctaccgccagcccgccgccggcgactgggacacgcccctggccaaaatggcgacggatctgcgggagtggctcaagaccatccggcgatgaccgcctcggccgccttctcggtcaggcggcggcggcggcgggggcgttcgccctccatcagcacgggcagcagcacctcgaccagaccctggtcgctgacatgggtgaagccgcgctccacgtggtggggatgggtggcgacctcgtggggctccagcaccggttcgaaggtgcagtcggcgggctccagcacttccgtccactcggccagggtgcgactggcgaacagcgccgtcatgtcggcgagcagatcatgctggggcaggggctcggcctggcgggcgatccagtcgggcttgccgatggccgtgcagaacgactgccagaacttctcctccagcgcggcgatggcggcgaagcggccgtccttggtctggtagatgcggtagaaggcggcgccgccgttgatcaggtcgtgctcgcgcttcgggtcgccccagcgctgcgccatcgtcagcacgccgcccatccacgacaacgccgcttcggccagagagatgtcgatggtggtgcccttgcccgaggtggagcgctttaagagcgccgccaggatggcgttgaccgccagcatggcgcccgcatggtcggccaggggcggaaaggtcatgacgggccgctcggccgggccggacgccgccagcaggccggtcactgccagataggtgacgtcgtggcccgcacgggtggcgaaggggccggtgccgccatagcccgacagggcgcagtggaccagccggggattgatctcgtgcaggcgcgtgatgccgaagcccaggcgctccatcaccccggggcgaaagccttccagcagcacgtcggccccggccaccatctcggcgaagcgggccttgccgtcggcggatttcaggtccagcgccacgatggtcttgttggcgttggccagcttgtagaaggcggtggtgccgtccgcgtccaccggccccatggtgcgcatgggatcgccggccgggctttccaccttgaccacctcggcgcccaggtcggacagccacagggtggccagcgggccgggaatgtacatggacaggtcgaggaccttcagcccggcaaggcaatcggcaatcatgctttagctccagaattgaattgtcatcccgagcgaaggcgagggatctcgtcctggcccggcatgtccggttaggaaacggcggagcagacggagattcctccttccgatggtcgtcggaatgaccggtttccctagacgctccagttcggctttctcttttcggtcagggccagcacgccctcgcggcattcggcaccggcccgggcgtcgacgaactgcgccacggtgtagcgcatgaggtcgggtccggcggggctgtcgtcgaccacccgcagcatgtccttggcggctccttgagccttgggggcgcccttgaggcaggactcgaccatcaggtcgcgggcggagtccagtttgtcgccggccaccaccgcatggatcaggcccaggcgcagcgcctcgcgggcgtcgaagcgctcgcccgacagcacgtagcggcgcatggcccgggtgcccatggcggcggccagatagggcatgatcagggtaggtgggaagccggcccgcacctcgggcagggagaagctggaatcgtcggcggccaccaccatgtcggccaccgagacgatgccggcgcccatccccagggcggcgccctggaccctggcgatcaccggcttggcgcagcggtcgatggcgtccagcatcaccgccatctgcatggcgctgcggctgacctcttccgcgtcctggtccagcatggcccgcgtccagccgatgtcgccgccggcgcagaagctggggccctggccctcgatcaccaccacgcgcaccgcctcggccacggacagcttctggaaggtctgggcgaggttgcccaccatctgctcgtccagggcgttgtgcaactcgggacggcgcagcgtcacggtggcgacggcgccgctgatcttgacatggatatggtcggtcatgctttcccctccccgggacaattgccccagtaaaccacggcatcgccagatcaaccaagatgcaagcagcgcaggcttgtggtggacgcgttccatttcctgttgccaggggcggctttgactgaaaccatggcggagcggggcgcagggggttccggcgcctgttcaagccaagagattccggagggtccatgacgtccaagtctccttccctgccgcgcgcctgtgccctggtcgggccgttcgccagcggcaagaccagcctgctcgaagccatgctgctggcctgcggcgccatcggccgccagggccgtatcaaggacggcaccaccacgggggattccagccccgaagcccgcgcccgcctgatgagcgtcgagcccaatatggccagcgccgaatatctgggcgagaagtggaccttcatcgattgccccggctcggtggagttccagcaagattcctataacgccctgatggcggtggacgtggcggtggtggtctgcgagcccgatcccgcccgcgccgtgatggtcgccccggtgctgaagttcctggacgagcacaaggttccccatctgctgttcgtcaacaagatcgacaccgccggcacccgtctcaaggagacgctggaagcccttcaggcggtgtccgaccgtccgctgatcatgcgcgagattcccatccgcgagggcgacgccgtcaccggctatatcgatctggtcagcgagcgggcctacaagtaccgccccggccagacctcggcggtgatcaagattcccgaggccctgaagggcgaggaaagcgcggcccgccaggaaatgctcgagcatctggccgatttcgacgaccacctgatggaagagctgctggaagacctgcagccgcccgccgacgagatctatgccgacctgggcaaggacctgaccggcgacctgatcgtgccggtgttcttcggctcggccgagaatgacggcggcatccatcgccttttgaaggccctgcgccacgacgcccccggcccggcggccaccgccgcccgcttagggatcaaggccgagggcggccccctggccaccgtgttcaagacggtgcacgccgcccatacgggcaagctcagcttctctcgcgtgtggcggggcgagttcgccgacaaccagtccctggaggcgggccgcatcggcggcctttacgtcatgaccggcggcacccccaccaaggtggccaaggccggcgtgggcgaggtctgcgccttcggccgcctggacagcgtggccaccggcgcggtgatcggcggggccggagaggacatggccgcctggccgcaacccctggcgccgctgttcgccttcgccctggccgccgagaagaagggcgacgacgtcaagctgaccggcgccatcgccaagctggccgaggaggacccctctctgtcgctggatcacggcgagttcggcgagcagatcctgcgtggccagggcgaaatccacctccaggtggccatcgaccggctgaaaagccgcttcaacatggcggtggtgaccaggaagccgacggtcccctacaaggagaccatccgcaagggcacctcggtgcatggccgccacaagaagcagtcgggcgggcacggccagttcggcgacatccatatcgacatcgcgccgctgccccggggctcgggcttccacttcgtcgacaagatcgtcggcggcgtggtgccgcgccagtacatcccctcggtggaggaaggcgtttccgagttcctgcaccagggccccttcggcttcccggtggtcgacctgcaggtgacgctgacctcgggcagctaccacgcggtggacagctcggacatggccttcaagacggcggcccgcatcgccatgagcgagggcatgccgcaatgtgatccggtgctgctggagcccattctggcggtggagatctcggtgccctccgacttcaccgccaaggcccagcgcatcgtctcggggcggcgcggccagattctcggctatgacgccaaggacggctggcagggctgggacaatgtctcggcctatctgccccaggccgagatggacgacctgatcgtcgagttgcggtcgctgaccatgggcgtgggcaccttctcgtggaagttcgaccacctgcaggaaatcaccggccgcgtcgccgacaaggtggtggaagcccgcaaggaggccctggccagcgcctgatgctggcgtttcgcccgaacccagtgctatagagcgggctccgacctgaccagaggagcccgctcatggaaaaccgcgaaatgttcgaagagatcgccgccctgatcggctcgatcgccaaggccttcgacctctccgacaccgacgtggtcgccgccatcgagcagggcagcctgggcatggagatgatcaccgatgccgagggacgtaattgcgtcgaggccagccatgacggacgcgtcgcccgcatctatcccggcgccatctaccgggtcggcgaccagcccccggccgccgacgaggattgcggcggcggcggctgttcctgcggccactgagcccgtatcttcaaagctgtcatcctgagcgaagcgaaggatctccgcctggagcggcggtgccggttctgaacggccgtgccaggacgagatccctccgcccgagggcgtcgggatgacggatcggttccatcctactcgatcatcgaccagtcgaaggcggtgccgcgcggcaccgccttgcgtgccttgcgccccaggatctcgggcaggaacttgggctccagcccatagccggggcggatggagcgcaccttgtcctcggtgatgatttcgccggggtgcaggtcctcgaccacatagagcgagcggcggaaggccttggagccctgctcgcactcggccagggcataggagatgcgtccgcgcgccacccaggcggtgcggcaatccttgaccagttgggccagttcctcgggttccagcgagaaatgggaatcgagcccgccatcggcgcggcgcagggtgaagtgcttctcgacgacgcaggcgcccagcgccaccgccgtcaccgccaccgccgtgccctgggtgtggtcggacaggccgaccggcacgccgaaggcctgggccatgtggggaatggtggccagattggcctcctcggtgggggccgggtacgagctgatgcagtggagcagcaccagttggtcgttgccggcccggcgcaccgtctccaccgtggcggcgatgtcgcccagcccggccatgccggtcgacacgatgatcggcttgcccttggccgccgcatgggccaccagcccgggatcggccatctcgaagctggcgatcttgaaggccggggcgtcgagacccgccaggaagtccaccgccgccttgtcgaagggcgaggaaaagacgatcagtcccagttccctgccccgctcgaacagcttggcgtgccagtcccacggggtctgggcctcggcgtagaggtcatagagcttgcgcccgccccaggggccgccctcgatgacgaagtcgggccggtcgcaatcgatggtaatggcgtcgggcttcagcgtctgcagcttgaccgcgtcggcgcccgccgccgccgccgcctccagcagggccagggcgcggcccaggtcgccgttatggttggccgacatctcggcgatgatgaagggcggatgatccggcccgatggggcgtccggcgatggaaatctcggtcatggggcaaggcctttcagggacggcaggcgtcggattgcgtcgacggtgcgggcggcgccccgtccgtcgcacagtttggcggcggcggccgacatggcgccaagctcggcggcggagagggcgagggcagcgggcaggtcgtccaccgcgatcaggcgggcggcgccgctggcgcccaccagccgggccacgtcgcgctgattgtcggcgatgaccagcatcagggtgggcaggcccaggcaacagcgctcccaggtggaggtgcctcccgctccgatggccagatcggccccggccatcagcccggccatgtccgggacgcccacgtgaaccgtgacccgggccatggcggccgcctgggccttgaccgcgtcgagatggggcgccctgacccccatgatcacgtcgatggcaaggccggaccccgccacggcccggagcaccgctccggtgacgttgtcggggtcggtgccgcccaggctgaccagcagccggcgcagggagccatcgcgccgcgccagggcggccgggcgggcggcggcgaattgggggcgcagcagggcgtagtccgacccggccagcaccagggaattgtgggggaccagttcgcggtattccccggcgctgcgcccgaaggtctggtcgagcagcaggtccgagtgatgccgcctcgtgggcaggtcgtcgatgaccattaccgcccggctcatgcttcggatgcgggcttcttccgccgcgtcgatgccgtaatggtcgatcaccaccagggcggcgccgaagggcagtcggtcgggcgtcaccaccggatagggcagcgacggcaccagctccgccgttcccgccgccgacacgaacaggcaggcggctccgcgccgggtcaattcatcggccagggtgaggcagcgcatgacgtggccgatgcccatggcggcggaagcgtcggcgcgaaagcagatggtgggcgtgaccatgaccgggaaactgagtagactcgtcgccttcagtataggcgggccggaggacagggcaaatggagttccgcagggcagtgattcaggacgcttccgatctgctggtctggcgcaacgatccggacaccatcgccaattccctgaccggcaaggcggtggccgaggccgatcatttcgcctggatcgcccgcgtgctggccagcccggacttcatcctgctgatggccgaacaggcgggcgagaagctgggcatggtgcgcttcgatcgcgaggaggatggtgagtgggaggtcagcatcaacctcaacccggcggcgcgcgggcgcggcctggcggcggatctgctggccggcagcatcgcggcggcctttcccgcaggggcgcgcccgccgctggtcgcctgggtcaagcaaagcaatccggccagcttgcgcatcttcgagcgctgcggtttcatccatgaaggcgacgaggatggggtcgaaacctttcggcttgccccttcttgtggagacggtgggcgcatgccatgatccgcccaaacgccattcccgccgaaggagcgatgccttgaccgcatcccagtactacgacatcgacctcgatctcgaaggaaagtccatcctggtcaccggcggaaccggttcgttcggcaagaagttcgtgaagacggtgctggagcgctacaacccccaccgcctgatcatcttttcccgcgatgagctgaagcagttcgagatggcccagaccttcgatccggcccagcatcgctgcttgcgctacttcctgggcgacgtgcgcgacgccgagcgcctgcgcatggccatgcgcgaggtggatgtggtggtgcacgccgcggccctgaagcaggttccggcggccgagtacaacccgttcgagttcgtgcgcaccaatatcctgggtgccgagaacgtggtgcaggccgccctggccaacaaggtcggccacgtcatcgcgctgtccaccgacaaggccatgagccccatcaacctctacggcgccaccaagctggcctcggacaagatcttcgtcgccgccaacaacctgtcgggctcggtgggaaccaagttcgccgtggtgcgctatggcaacgtggtggggtcgcgcgggtcggtggtgccgttcttccacaagctgatccagtccggtgccgccgaactgcccatcaccgatgcgcgcatgacccgcttctggatcaccctggagcagggcgtcgacttcgtgctgtcctgcctggacaagatgcagggcggcgagacctacatccccaagattccctccatgcgcatgaccgatctggccgaggccatggcgccgggcaagccgcacaagatcatcggcattcgcccgggcgagaagatccacgaggtgatgatcaccgaggattacgcccgcaacacggtggaactgcccgaccgctacatcatccagccggtcttcgccttctggaccaccgagcacctgatcgacgccggcgccaaggtggtgcccgacgatttccgctatggctcggacaacaataccgactggatggacgggccccggctccacgccatgctgtcggggctggaactgtgagcggggaggctttccttccctattgccgccatgtggtggacgaggatgatatcgccgccgtggcggcggtcatgcgcggcgacatcctgaccaccggcccggcggttgccgctttcgaggacgccctggccaaggtggtgggagcgcggcacgccgtggtctgcgccaacggcaccgccgccctgcatctggcggtgctggcgctggagatcggtcccggcgacgccgtgctggtccccgcccagaccttcgccgccaccggcaattgcgctcgctatgcgggggccgaagtggtgctgaccgacgtggaccccgacagcggcctgatgcgggtcggggacctggaagccgccatggccgcccatccgggcaagcgcttcaaggccgtgctgccggtccatctcaacggccagtcggcggacatgccggggctggccgccgtggcgcggcgccatggcctgaagatcatcgaggattgctgtcacgccctgggcaccgtcgccgccgacggcacggtgatcggcgattgccgccatggcgagatgaacgtcttttccttccaccccgccaagaccatcgccatgggtgagggcggggcgatcaccaccaacgacgaggccctggccacccgcctgcgcctgctgcgcggccacggcatcacccgggattcggctgtcttcgtggaccaggagggcggcttcgacgattcgggcgcgcccaatccctggtattacgagatgcaggcgctgggcttcaactaccgggcctgcgatatccagtgcgccctggggaccagccagctggccaagctgccccgctttgccgaggcgcggcgccggctggtgcgccattaccgcgacaggctggcgccgctggctcccaaggtaaagcccatcaccctgtcgggcggcgaggcggtctggcatctgtcggtcgccctgatcgactatcaggcctgcggcaccacccgcgcccaggtgatgaacgccctgcgcgccagggggatcggcacccaggtcaattacatccccatgcacaagctgccctattaccgggggctgctgggcgacatcagcctgccgggcgcggaagaatattatcgccgctgcctgtccctgccgctgtccgccgccatgaccgaggcggatgtggaccgggtggtggagactctgcgcgaggtgctggggctgtgacgcggggtaaggctgtcatcccgaagaccagcgggaggagggatctcatcctggaacggcgttttaaaaccggcatcatcgtcgcaggcggagatccctctcctgcggctcgggatgacactccatgaccgccgtggtcatcgtccaggcccgcatgggctcgacccggctgccgggcaagatcctgaagggcctgggcggcatgagcgccctggcccagtgcctgcgccggtgcaaggccattcccggcatcgaccgggtggtctgcgccatccccgaaggcgaggccgaggcgccggcggtggccgaggcccaacgctgtggcgccctggtggtgcgcggcccctccgacgacgtgctgaagcgctatgccctggcggcgcgggcggcgggcgccgacatcgtcatgcgggtgaccagcgactgtccgctgatcgacccggatttgtgcgggcggctgctggccaagctcagggccgaggggctggattactgctgtaacaacctgccgccctcctggccccacgggctggatgccgaggtgttccgggccaccgccctgttcgaggccgaggacaaggcgacagagcccttcgaccgtgaacacgtcaccccctggctgcgccgcgcgccgcacctcaagcgcggcaatatcgcccgcgaggaaggcgacctgtcccaccaatgccggtggacgctcgactacccggaggattacgccttcctggcggcgctgttcgagcgcctgcccgaagccatcgtgtccatggaggcggtgctggcggtgctggcggccaaccccgcgctggccgatatcaacgccatgcgccggggtgtccgggcgatgcccgttccggccaagggggcgtcggtcagcgaccggcgatgaaccggtccacggcgcgataagcgtcttcctcgctgcccaggaacatgtggtagcccgcgtggcagacgtcgccgcgcccggccgtgccgccatccacccaggcgaagtccacgtccgtcttgccggcggcccgcagggattcgtagatatcgacgtcggcggcgggattggccttcgagcaggcgtcgcggcgatggtgcaggaacaagatgggcaatcccacgtcggcgcccaccttcacccccacccgcgacgagctgaggatggcgcccgccaccagatcacgatgggtgcggatgaactcggcgacgctgatggcgccattgctgtggccctgcagccaggccggcatgccgaagcgctggcggtagaaccgcacgacgctttcgatgcggcgctggtggtcgctggaaatgcgcgaggtgggaaagaccggatcggtgggcagggcgtaggggctgccgaagatcaccacgtgcaggttgccagaactctgcgccggttcggacaggggcttgaagacccggctgtagatgccgcccagatcggtcttgcccggctgcaggccgatatggccttcgccgccgggaatcatgatcagcaccgccttggggtgcggggattcccacaggaaggtctgggtcggatcatccgcgccatcggccatggggacggggatcacctccgctccagcggggcaaagcggcgcgacgcccagaagaagggcgaacaggaaccaggaagcccgcatgatgcttctccgtccgaaagagaatggccccggatgcttcggcaaaagcatccggggccatcatcgcacaggttcctggtgggaagctgactaccgtccccggccggcgtgcatctgggcatccaccgccgccagggcggtgatgttgatgatgttgcgcaccgtggccgagggcgtcagcacgtgggcgggctgggcgatgcccatcaggatcggtcccaccgacagggcgtcgcccgccaccttcagcaggttgaacgagatgttggcggcgtccagcgtcggcatgaccagcaggttggcggcgcccttcagcttggaattggggaagatgcgggtgcggatttcctcggacagggccgcgtcgccgtgcatctcgccctcggcctccagatagggggccttttcgcgcagcagggccagggcgtcgcgctggcgctgggccgaggcggtctggcggttgccgaaattggcgtgggacaggaaggccaccttgggctcgataccgaagcgtcgcacctcttccgaggccagcaaggtcatgtcgcagatctgctcgggggtcggctcgggcgtcacataggtgtcgcagatgaagaaggtgccgatcggcatgatcagcaggttcatggcggccgggaccttgacgccttcccgcgtgccgatgacgttgaggatgtgggacaggtgcttgtcatagcggccgatggtgccgcagatcatggcgtccacttccttgcgcttcagcatcagggtgccgatcaccgtgttgcgggtgcggaccacggtgcgggcgtattccgggctgacgccctggcgctccatgatggagtggtaaaggcgccagtactcgttgaagcggggatcgtcctcgggatcgcacaggtcgaagtcctggtcgatgcgcaggcgcaggtccaggtcctgaatgcgcttttccaccacttcgcggcggccgatcagcacgggacgggccagcccctcgtccaccacggtctgggcggcatgcagcacgcggcggccctcgccctcgcaatagaccacgcggcgcatgtcctggcgggcgcggtcgaacaccggcttcatcaccaggccagagcggaacacgaactggttgagccggtccatgtagacgtcgaaatcgatgatggggcgccgcgccacgcccgattccatggccgccttggccaccgccggggcgatcttgatgatcaagcgggaatcgaacggcttggggatcaggtattccggcccgaaggtcagtggcgcggtgccataggcggcgcgcacccgctcatcggattcggccatggcgagattggccagcgcatagacgcaggccagcttcatggcgtcgttgatctcggtggcgcccacgtccagggcgccgcggaagatgtaggggaacaccaggacgttgttgacctggttgggatagtccgagcggccggtggcgatgatggcgtcgggacgcaccgccttgacctcgtcgggcaggatttccggggtgggattggccagggcgaagacgatgggcttttgcgccatcttgtcgaccatctcgccggtcagcacgcggggcgcggacaggcccaggaagatgtcggcgccctcgatgacctcggccagagtgcgcatgtcggtcttcttggcatagatggacttgtactcgtccatcagctcggtgcggccctcgtagaccacgcccttgatgtcggtgacccagacgttctcgcgcttgacgcccagcttgaccagcaggttgaggcaggccagcgcggcggcgccggcgcccgaggccaccagcttgacgtcggcgatgtccttgcccaccacgcgcagcgcgttgaccatggcggcgcccaccacgatggcggtgccgtgctggtcgtcgtgcatgaccgggatcttcacccgctcctgcagcttgcgctcgacctcgaaacactcgggggccttgatgtcttcaaggttgatggcgccgaaggtgggctccatggcggcgatgatgttcaccagcttgtccgggtcaagctcggccagctccatgtcgaacacgtcgatgccggcgaacttcttgaacaggacgcccttgccctccatcaccggcttggcggccagggggccgatggggccgaggcccagcacggcggtgccgttggtcaccacggccaccagattgccgcgcgccgtcacatcggcggcgctgtcctcgtcggcgacgatcagctcgcaggcggcggccacaccgggggaataggccagcgccaggtcgcgctgggtggccagcggcttggtgggggtgacgctgatcttaccgggggtgggcaggcgatggtattccagcgccgcgtcgcgcaactcgtcggacatgctcatgggaacggcaacctctggcgtaatgttatttcttggaccgggccgataccatactcgcttgggggcgccgcgcaaagcctctgatcggatgaatttcggaaaaccacaggaaatgcaatggtatggcggtatgaccactgcgttggcgccgagtcataaaattgcgcgaatgccccaaaacaaccaagcccgccggggttgccggcgggcttgacaggttcagatggtgcggccaagaagactcgaacttccacgggagttaccccacaagcacctcaagcttgcgcgtctaccagttccgccatggccgcgttctccggtagcctcgaagggcttgccaacgaggagacaggggaataccaaatcacctcgaccgaatcaagcacgctctcccggagtccctgatgaattatcccgtcgagtggcggatttccgattctcccgtggattatccccaggcgatcgccgccatggaggagcgcgtcgccgccattcgggccggcactgcgcccgagctggtgtggctgctggagcatccgccgctctattcggcggggaccagcgccgacccccgcgatctggtcgatcccggccgctttcccgtctacgagaccgggcggggcgggcagtacacctatcacggccccggccagcgggtggcctatgtgctgctcgacctcaagcggcgcggcgccgatgtgcgggtctatgtctgcaatctggaggaatggctgatccgcaccctggcgcgcttcgtggtcaagggcgagcggcggacgggccgggtcggcatctgggtggaccggggaggagggcgcgaggacaagatcgctgccatcggcgtgcgggtccgtcactgggtgacgtttcacggcattgcgctgaacgtcgaccccgatctgtcccacttcgagggcatcgtgccctgcggtatccgcgagcacggcgtcacctccttgtgggatctgggcctgacccccaccatggatgatgtggactgtgccctgatggccacctttcccgaggtgttcggggcggattagcgtggcacggagaagtccaccggcaccgccggcccgtcgggctgcgagggcatcaggggccagaccggttcgtgggccgccatgggcggggagggaagctcccaataggcccgggtctcctcgaagcgcgccaccggccccaggaagcgcaggcggccttccggcgtgtcgcgggtggtttccagggcgcggatggtctcgggcggcacggtgatgccggccggcttggcgccgatgccgcccagggactgaatccacagggcggttcgcgacagcgagacccgcacgtggtagctgccgccctccgttgcccggcgcagcagcgccacggccatgccataggcggccagatagcccgtggtgtaatcggtgggaatgaccgggctgacccggggctcggcgatggagccgtcggccacggccatgcccgacgccgcctgggccagttgttcccagccccgtctgccgttccacggtccgccctcgccgaaacagctgagcgacatgcagatgatgccgggccgcagcttcaccgcgtcctcgaccgagaatcccagcccggcgacggcgccggggcggtagttctgggcgaagatgtcggcctcggccagcagggcgcgcatgcgggcggcctcgggctggcgcttcaggtccatcaccgtggacagcttgccgtggccggtgtccaggatgaaggcgggaatgatcgggcggtccggcgggcggatgcgcagcacggtggcgccctgttcggccagggtccgggtggcggtcggcccggccagcacgtcggtgaggtcgatgacccggatgccggacagggggcgggccgcgggcttcaacggttcgggcgggctgtcgccgatgcgctcgacgctgaccaccggctgggcggccagccaggcgccctggggatggtccagccattcctggcgggtacgggcgacgttgccgcacaggccccgcgcggcgatggcatcctccagctcgaaggcattccactgcgccaccttggcgcggatgcgctcgatgctgttgggacagtccagcagttccagcaggccgttgcgcaggtgggggtagccggcatgaagatgaatggcccggccgtcccgcgtcggatggaaattggtcaggggatagttgatgtcggtatagggcaccgtatagccgcgccgggtcatcagggtcacggattccagggaaagcgccgcggcgcccacatccaccgccacatgctgccttcgtccgctgcgccggcgccagatctcggcgatggcggcaccctgggccgccaggattgcggcggcggcctcgcccacccggtgggtggtgggaaagtagggatcctgcccggtgatgtcgatggtcccgcccggccggtcggacagcccgcccagtgccagcaattcggccaacgccctggccgcaggcttctccaattgcgccgacatcgcgcttttctccggctattttacagctataagtagctcatacgccatatggacgtatcactcggctacgctgtttaccctatagctgtttccggagaaacaaaagaatggtcaagcgggtatatacttaaatgcatacacttaatcgatgcattggacaaagggctgccttagcctttgaccaggtggttgagcaggcgcccaaggttcttgggattgaaggctttggggtaaaggccggtggcgccggcctccatcactttctggatgaggtcggcgtcgtcggtatcgctcagcagcagcagcggaatgcgggcgatgtaggccttgttgctgccgcgcagcgctccggccagagcggagccgtccaggggctcggcttccaggtcgcagatgatgaagtcgggaaccggatcgccgaaggccatggccagccccttgatgccgtcctcagcctgcagcaccctggccgctcccaggccggtcagcagatcggccagacgtccccggcgggcggcatcggaatcgatgaccagggcggccagatcgtgggacgccagcttttccggggcggcgtccgggtccttggggggcgccacccagtcgcgcatgccggtgtcgaatttcttgacgtggccgatcagccaggccttgagcaactcgttgacctccagcaccgaggactcgttcaggggcttggtcttggcgatgaaataggcccgggcgatctcgcgcacctgatccagcaaggctttgtgctcgtggaaatggcccggttgaaggggatacaggcactggcgctgaatgcgctcctcgcggctgaagtggtcccggccataagccagcagggatttcagcgtctcgtgcaggacctgcgaattgtccgcggctttcgagtgttcgagaaactcgttgatgatctcgatcagccgctggtgatcggcatcgatcaccggatggccgattcgcaggtcgtcggtcagttcaagcatcgccatgtccccccggagcgctgatggatcccttggaatctatcgtatgccccggggagagagctagtaggcgtagccgatcttcagcatggtcagccagttgtcggcgctcgacgcgccgcccacccgttcatcgccggcccactgatagcggctttccaggccgaccatcagctggcccgcggtgtaataggcgctggcgcccagttggacggtgaccatgtcggggctggggccggactcggaatgggtgaagacccagcccacccccggtccgccgcccacccacagattctcgacgatgggaatcatgtagtgcgggttgaactccagggtctgaagctcgaggccgccatggtcaaagcggttatagctgaactggtcgcggatcttgccgtagggcagctggaacagcgggtcgtcgacggccagttcgaagccgccggccagaccgctgccgaccgaggaatcgggaaccatggcgcccatcttcagggcaacggtggtgttggccgaccagccgtgctgggcggcggcggggaaggcccagtccccgccccaggcgggaagggcaatggccgtcagggcgagggtggcggcgatgagaaggcgtttgcgcatggcggacctccctgcttacgggtggaacgcgctcctatgtcaaggagtctgggcctcgcggggcttcgcttcaatgaaccgcctcacagagcggcattgcaggaatagctgggactgggattcatgttcgcccctctgcctaagcgcgtgcctacggcacgcctggccgcggcctcgatggccgctggagcgatctgtgtcagattcagcgcaggttgctccaccgttgcacggtgggaccggttccgccaatatccgctccatgtccgaccccttcgcccttgatgacgaggctcccgcctctccgcccccgtcccgtgcttccggcccccggccggtgccgcccgatgccccctggctgcaaggcctcaaccccgagcagttccaggcggtgaccaccaccgacggcccggtgctggtgctgtcgggggccggcacgggcaagaccaaggtgctgacctcgcgccttgcccatatcctggcctccaacctggcccagccctggcagtgtcttgccgtgaccttcaccaaccgcgcggcgcgcgagatgaaggagagggtggggcaactggtcgggccggtgtccgatggcatctggctgggcaccttccactcgctgtgcctgcgcatcctgcgctcgcacgccgaggcggtggggctgggcggcgacttcaccgtgctggattcagacgaccagatgcgggtcctgaagcaggtgatggccgaggcccatgtggaccccaagggcacaccgccccaggggctgatggccaccatccagcgctggaaggaccgcgccgtcacccccgacaaggcggcggccgacggcggcgccgaggggcaggccaagacgctgtaccgcgcctatcaggaccgcctccggtcgctcaacgcctgtgacttcggcgatctgctgctgcacgtgctgaccgtgttcctgagcgacgccgaggcgctggcccgctggcagggccgcttccgctatctgctggtggacgagtaccaggacaccaacgtcgcccagtatctgtggctgcggctgctggcccagacccaccgcaacatctgctgcgtcggcgacgacgaccagtccatctattcctggcgcggggccgaagtgggcaacatcctgcgcttcgagaaggacttccccggggccaaggtggtgcggctggaaagcaactaccgctcgacgccccatatcctggcggcggcgtcgaccctgatcgccaacaacgaggggcggctgggcaagacgctgcgtcccggcatcatccacgagcccgaggccatcgagaagatccgcaccaaggcggtgtgggacggcgaagccgaggcccgcatggtcgccgaggagatcgagaccctgcagcgccggggcgagaagctctcctccatggccatcctggtgcgcgccggcttccagacccgcgagttcgaggaacggctgatcaccaccggcattccctaccgcgtcatcggcggcccgcgcttctacgagcggctggagatccgtgacgccatggcctatctgcggctggtggtctcggccgccgacgggctggccttcgagcgggtggtcaatacccccaagcgcggcctgggcgaggcggcggtgcagaccattcacatggtggcccgcgccgagcaggtgccgctgctcgaagcggcgcggcggctggtggacaccgatgagctgaagcccaaggcccgtcaggccctggcccgcttcatcgaggatgtggaccgctggcgctccttgctggagtccatgccccatcccgaactggccgccaccattctggacgagtccggctatgtggacatgtggaaggccgacaaatcggcggacgcgccgggacgggtggaaaacctgaaggaactggtggcggcgctggaggaatacgattccctggccagcttcctcgaacacgtggccctggtcatggagaacgattcccgcgccgacctggacagcgtggtgatcatgacgctgcacggcgccaaggggctggaattcgactcggtgttcctgcccggctgggaagaggaggtgttcccccattcccgtgccctggccgaatccggcaccaaggggctggaggaggagcgccgcctggcctatgtgggcctgacccgcgcccgcaagcgggtgctggtgtcgttcgccgccaaccgccgcatctacaaccagtggaagtcgcagcttccgtcgcgcttcgtcgaggaactgcccgagtcccatgtggagcgctcgggcgagcgcggcctgcatggcggcgggctggcggaatccaaggccgcctggaacgaccccgcctggagccgcgcccgctttggccagccccgccgcgagaccgccgccgctccctcctgggggcaggccaagccgcgggaaagcgccggcggcttcaagcccggcgcccgcgtctttcacgacaagttcggcaacggcaccgtgctgtccctggacggcaacaagctggaaatcgccttcgacaaggcgggcatcaagaaggtgctcgacagtttcgtgtcggcggtgtagccgaaggacgaaaccctcatcccccgcccgcgcccgggatgacaggatcacaggaaagagacacgcccatgccccccgtcttccccgacatctggcgcctgcgcctcaccgtctccatggagacccttccggtgttcgaggaggtgttcgagcgccatgccgaggcggtgaccatgttcatggaggaccgttcgggcatttccgacggcgagtgcgattggttcctggaaggcttttcccgcacgccgcccgatcgcaccgccatcgtttcggccatggccgcattggccgccgccaacggcatcgatgcgccgccgctggagatcgagatgctgcccaacgtggattgggtgctggagaatctgcgcgacttcccgcccatcagcgccgggcggttcttcgtccacggctcccactgggagggcaagccgccggtgggctccatcggcatcgagatcgacgccggcaccgccttcggctcgggcgagcacgccactacaagggggtgcctgctggccctggatgccctggccaagaagcagcggcgccgggcggtgctcgatctgggctcgggctcgggaattctcggcatcgcggcggccaagtgctgggccaccatggtggtgtgcaccgacatcgacccctcggcggtcaaggtgctggccggcaatgccgccaataacggcgtcggccgcttcgtcaccgccgtggtcagcgacggctaccgcaatccggtggtggggcggggcaagccctatgacctgatcttctccaacatcctggcgcggccgctgtgccgcttcgcccccgatctggccgcccacctggcccccggcggcctggcgatcctgtcgggcctgctggagcgccaggagcgcatggtcatggccaatcatgaacgccagggtttgacgttgaagaacagaattgtcatcgacggttgggcgaccttggtcatcggccgatagggtggggttaataccttagaccgttagacatagtgtctatgacctgagatttcataaggcaggacatcatctgtccctgggtgagtattaccctggggagggtgagtcatgcacttgtcgctgaagctcaggattttcgccgccgtcggtctggtcggactggcggccgtcgccatggccctggtgggcatccgttccatggccacctatcaccagcacgtgatggagatgcaatccgcgtcccagcgggcggtgatcggcgagaaggtcaacggcctgatcaacgcggtggtgatggattcccgcggggtctacatgagccgcgacgcccgcgaggcggagaaatacgctcccgccattctcaagaacgtggccgagatcagccggctgatggccgactggaccgcgctggttcccgaagccgaacgcggcgccttcaagcccgccgtcgagcaggccgcccagttcgccgccttccgcgccgagctggtccgcctggggcgcgaggtcagtaccgccgaggcccgcacctttggcgacaacgacgccaaccgcgccaaccgccaggccctgaacaagcagatcgaggccctggccgccgccaactcggccaaggtcagcgacctggtccaggggctggacgagttctacgaaagccgcctgcaggccatgatctggctggcggtgctgggcctggccgccggaatcggctgggcggcctggacggccttcaagcgggtgtcccagcccatcaacgacatgaccgccaccatgcgggaactggccggcggccatctggcggtggagatcccctcggtggaggcccatgacgaaatcggcgagatggcccgtgccgtccgggtcttccgcgacgccatgcgggcggccgaggccatgcgtcaggcgcaggagaaggagcgcgaggcggctttcgccgagcgggtctccgccctgcaatccatggccgagaccgtggaactggaaacccgcgccgccgtcgagcaggtggcggcccagaccgcgctgatggccgagaatgccggccagatggccaattccgccggcgcggtgggcggcagcagccaaagcgtcgccgccgccgccagtcaggcctgtccaacgcccagacggtctccgccgccgccgaggagctgtcggcctccatccgcgagatcggccagcagatcgccttggccgggcaggtcaccggcggcgccgtcgcttccgccgaaaaggcccagggaaccatcacccgcctgtcggccgccgtgaaccgcatcggcgaggtggccaacctgattcaggacatcgccagccagaccaatctgctggcgctcaacgccaccatcgaggcagcgcgggcgggcgaggcgggcaaaggctttgcggtggtggccaacgaggtcaagaacctcgccaaccagaccgccaaggccaccgaggagatctcggcccagatcggcgaggtccaggccagcaccgtcgacgccgtcgcctcggtcgccgagatcgccgccgccatcaaggaggtggagggcgtctcggtcagcgtggccggggccatccgccagcaggacgccgccacccaggacatcgcccgcaacatcgctcagaccacctccgccgcccgcgaagtggccgagcgcatcgccgaggtgtcggaggaggccggcatcacgggcgagcgggccgccagggtcaaccacatctccgtggacgtggcccgctccatcgagagcctgaagagcgtcatcgtcagggtggtgcgcaccgccaccaaggaagtggaccgccgcaacgcgccgcgctacgcccttggcgtcaaggggctggtggacatgggcggcgccgaggtgccggtggtgttcgacgaggtttccgaacggggcctgaccatccagggcgacgtctgcccggtggccaagggcatgcgggtcaaggtgcgcatcgagggatgctcggtggcgctgtccatggtcgggcgggaatgcgagaacggccgcctgcacggcaatctggagctcacccccgacgtggagacccgctggcaggaggaattccagcgtctcatcctcggccgccatcccatccgcgatgccgcctgaccaaatggattatacggttcgtcaacattcacctcgttagggcacaatttgtcgcaatctgtggaaaagttggacaggagcgctcttgatgagtatcaagggcgcggggagtagggctctgatttgacgtgttccggggggaaatggacgacttgaaattcaaggccaggatcagcatcacccgagttgtgtttctgctgtccctgacggcgaccgtgctggcgcttggcgtggttgtcctcatctccggccatgtgcgcgagaagtcggtgaacgacctcgcccgcgacgaggcgcgccagacctcgaccctggtgttcgagaccctttacgccgccatgcgcaagggctggagcaaggatgagatcggcgaggtgatcacccgtctgcaggtggcgctgcccgacctgtccatccacgtcatccgcggccgtccggtgatcgagcagttcggcgagatcgccaacgacgtcgccatcgtccgtcacgatccgctgctgcaggaggtgctggcctcgggcaaggagacgctgctgcccagccccacaggcatccgctacctctatcccctgatcgtcagggaggagtgcctggcctgccataccgcggccaaggtgggcgacatcaacggcgtcatcgacatcgtctatccggtgcatgcgctgaaggtatcgctggattacgtgttgaacacggtgctggcctatttcttcgccatcctgctgctgctgtcggcggcgctgtacttcaagctgaaggtcttcgtggcgcggcccatcaccaacatggtggcgctgatgcaggagatcatcctgcacaccgacctgtcgcgccgcgtcgagaccaagggcatcatcgccgaagtggccgacctgtccgactatttcaacaagctgctgcgcacggtggaggaataccagcaccggctggaggacctgtccatccgcgacccgctgacccgactctacaaccggcgcaagttcgacgagttcctcgaccacgagatcgaccgcgcccagcggcacggccatcccttctgcgtcgcccagatcgacctggacgacttcaagaacatcaacgacaccttcggccatcccatcggcgatctggtgttgaaggaactggccagcgtgctctaccgcgaggtgcggcgcaccgatgtggtggcccgggtcggcgccgacgagttcgcggtgctgctgccggaaaccaccatggaggagggcgtcgctgccgccgagaagctgcgccaggccgtggccgactgccagttggggctgccggtgggcggcgtgcgcatcaccgcgtccattggcctggtgggctatcccgataatgccgacgacgcccagaagctggccatcgccgccgacgtggccatctacaaggccaagcgctcgggcaagaatcaggtggcggtgatcggcgagggcgaggacgccaccgtggccatcttcagccagggcgaaatggtgcgcagcgccttggccgagggacggctggtgccgttcttccagcccatcgtcgccgccgaggacggctccgtcgccgcttacgaggtgctggctcgggtggtggacggcgatcaggcggtctgtgccggcgatttcatcgaatccgccgaggaactggggctggccggcgagatcgacgccgccgtgttcgacggcgccctggaggccatggcggcgggcaagctgggcgatgccaagatcttcgtcaacctgtcggccaagagcctgaccgaccgcgagcgcatgatggccatccccgaacggctgcacgccgccggggtgtcgccgtcgcgggtggtgttggaaatcaccgagcgcgaggccctgccccatttcggcgacatcgtcgccatgatcaacgagttgcgcagcaccggactgggcttcgccctggacgatttcggctcgggcttctcgtccttcctctatctcaaatacatcaccgtcgattacgtcaagatcgagggcagcttcatccgccacgtggtcaccgacgagcgcgaccgcatcatggtcgagcacatccattccatggcccggcgcttcggcatgatcaccatcgccgaattcgtcgaggacgaggacaccatggtgctgctgcgcaagatggggatcaacctgtgccagggcttccatatcgcggtgcccaagcccattcacaagctgtgatgcccgccgcgacgcccgatgacctgttcgccctgttcgaccgcctggacatccgggcggtcacccatcaccacgagccggccttcacggtggaggaggggcaccgggtgtggggcgccatccccggggttcactgcaagaacctgttcctcaaggatggcaaggggcagttgtggctggtagtggcgccggccgagcgccgcgtcgacctcaaatccctgccggccaggatcggttcggcgcggctgtccttcggctcggccccgctgctgaccgaagtcctgggcatcgagcccggatcggtgacccctttcgcggtgatcaacgacacggatcatcgggtgaacgtggtgctggattcctggatgatggaccaggacctgatcaactatcaccctttgcgcaatcatatgaccaccaccgtgaccccggccgagctgattcgctttttcggacacacgggacacgctcccctgaccgtcgaactatagccgagggtattgccccctctccctgaattgcgctatttcctctgcctgattgggacgttcgatggggccttttcgaaaatggtaatgacctttgtacggtgtctcgctgtggccgtcgtcctggtgctcggtgttttcctgggaacaggtgtcgctgccgcagccgatgtggagatggggcgcaagaccgttcaaagcgcggtggacgagggaatcgccacctttgtcggcaagaagctccccctgcccgagcgggcttcgcgcctggatggcctgctgcgccgctatgtggacccgtccatgctgtcggccagccttctcgggcgctattggggcaagatcagcgaggacgagcagaaggccttcaccgaactgttcgtgcgttacttggtgacgtcctatgtgggcattctgggtcgtgccgagcccggcaccaccctcaaggtgacctcgggaaccgacctgggggggcgggtcaaggtgcagtccgtcgccatgctgccctcccagccgggcgagcccattccggtggagtgggaggtggccaatgcccccgacggccatccggtgatcatggatctcaccgcccagggggtcagtctcatccgtgccatgaaagacgatttcgcctcggtgctgcgcagctcgggcggcaaggtccagcccctgatggaggccctgcagcgcaagatcgagtccaacgaaaaggaaaacgccgccctggccgggtgatgacggctcaggctcccaggtagaccagcttctcgccctcgacgaactcgcccgacacggcaagatccttgaagaagtcgaccaccgcgcgggcctggccggtcagcgcgttgatggggccgggcttcagtcccaggccatgggccttgagcagccggggctcggcctccttggcggcgaagtacagcgccacgtcgtcgcccttgggcgccgccatcagggtcaggcgcgccgcatccacgtattgcaccaggaacaggccgggggccaggcgggcggcgcgggccttgccggtggggccgtccggggtcgccacgtcgtattgcttctccgccgcgttccaggtgacccgcacctcgacgccgtcggggcggcgatagcggccgtccttgaccccatccacccggaccgaggcggcgggcgcgacggtgtcgccctccacctgatagcaggcgggcagcaacagtacgaacagcagggcggcgaggcggcgcatggggaatccttccggcggaattgtggctggaccctatcacccctcggggcatggtgaaattgacctcggccaagtacttgttccgcccaggacgaatcgctaaagtccgcgccttgaacgccccccggaggaagtcatgtccgagcgcatcctgatcgtcgatttcggctcgcaggtgacccagttgatcgcgcgccgcgtgcgcgaggccggtgtctactgcgaaatccatcccttcaaccgggtctccgtcgacagcatccgcgagttcggccccaagggcgtgatcctgtcgggcggcccggcctcggtggccgatttcggcagcccccgcgccccccagggcctgttcgagatgggcctgcccatcctcggcatctgctacggccagcagaccatgtgcgagcagttgggcggcaaggtcgagccgggcgaccaccgcgagttcggccgcgccatgctccaggtctcgggcgagccctgcgccctgttcgacggcatcgccgccaagggtgacgaggtccaggtgtggatgagccacggcgatcgcgtcaccgccattcccccgggcttcaaggtggtcgccacctcggaaggggcgcccttcgccgccattgccaatgcggacaagcggttctacggcgtgcagttccaccccgaggtggtgcacacccccatcggcaagcaattgctgtccaatttcgtccacaagatcgtcggctgcgccggcgactggaccatgaaggccttccgcgcccaggaaatcgccaaggtacgcgcccaggtggggtcgggccgggtgatctgcggcctgtcgggcggcgtggattcctcggtggtggcggccctgctgcacgaagccatcggcgatcagctgacctgcgtgttcgtcgacactggcttcatgcgggccggcgagtccgagcaggtggtcagtgtcttccgcgaccgcttcaacatcaagctggtgcacaaggacgcctcgggcctgttcctcgacaagctggccagtctcaccgatcccgagaagaagcgcaaaatcatcggcgccaccttcatcgacgtgttcgaggaggaggccaaggcggtgggcggcgccgacttcctggcccagggcaccctctatcccgacgtgatcgaaagcgtcagcttcaccggcgggccgtcggtaaccatcaagagccaccacaatgttggcggcctgcccgagcgcatgaacatgaagctggtggaaccgctgcgcgagctgttcaaggacgaggtccgcgcccttggccgcgaattgggcctgccggccgacatggtcggccgccatcccttccccggccccggcctggccatccgcatccccggccagccgctgacccgcgagaacctggacatcctcaggaaggccgattccatctatctcgacgagatccgcaaggcgggcctttatgacgagatctggcaggcctttgccgtgctgctgccggtccgcaccgtgggcgtgatgggcgattcgcgctcctacgactacgcctgcgcgctgcgcgctgtcaccagcaccgacggcatgaccgccgatttctatcccttcgacatggccttcatcggccgggtggccaatcgcatcatcaacgaggtcaagggcatcaaccgggtgacctacgacatcaccagcaagccgccgggcacgattgaatgggagtgacggttaccggccggagtgtctcggcgtaacgccgaagcgctccgggcgcgggagagtttgatgcttgggcggggggcgaaccgaatgcgcgcctgtttcggcttgaggccgccttacgattttgccagggcgatgccgttcctgatcgcctgcctgggactaatggtcattttggtcctggggggctttcaggccttcggcgccggactgagcccgacggcgaatcgggcgatttttctctattacgtcgccatgctgctcctggcgtccatggtttcggcgcggtggcgggtggcctcttggctcctgctggccctggcgatgacggaattgctgctggccctggcgacccatgtgggccatgccatgggcctgccgattccgtcccttctgccgaacagggaggcgttcttcggggacggccctcgcttcaagtatcatccgctgctgatggccgtgcccaaggagggcttcgtctccacccgtggcgtggacatccggcacaaccgtcataatttgcgcgggggagagatcaccctgggggcgggccagcggctggtgaatgcctatggcggctcgaccacctatgatgtggcggttccgcaaggggccacctggccggaacggcttgggggcgaattgggggatgactgggtcgtcgccaatttcggcgtgccgggctacagctcggcggaacatgtggttcagacggcgttctacgccgaccggttgggcaccatgccggtctgttcgctgtactacatggggtggaacgatctgcgaaatgcccatctcccggatctggatgcgggctatgccgatttccatctgctgtcccagccgggaaatctccagattcgcggcggtggcggtgccagtccgctgtatcgggtcctgtcggcggccttgagcgcgtcgttcgataccatcccgtatccgccggattatcaccgcctggggccggccgatggtcctgacgtccggctggaggacatcttccgaaagaatatccaggccatccacgcgctgaacgcggcgcgcggcgtccgaagcgtttttatcggccagatgctgaatccgttccgtcatgacgcaggcttggggccggaatggcttccccgggtgagggaccaggatgtctggccgctgcaacagcggctcaatctgatcatgaagctggaagccgagcggttgggggcggcatccgtggtcctggagcccgaggcgttcgaggcgtcggactttgtcgacaaggggcatttctcggtggaaggctctcggaaattcgcccgcctgatcgccccagaagtccggagactctgtcgccgctgagcgtccgtaccggccgatgtaacgtagcgacatcatctttcgtcaatattatcgttcgatgactgggggctccacccgattgtcatagttccgatttcggataagtataatcccggtgttgaacgggaatctggacgatggggtaccaggataacaggcgttgcgcctttgacaggctgatgagcatggcgggggattccctgtcggccgagcatgccctgtccgtattgcgcaatgccggcgcgtgcaacgcgctgctgtcgtgcccgcgccggctgggctgctcgtggatggccatgatcgtggcgtcgcggctgtccgaggcggccatcgccgccgccgagcgcgaccgggtgctggccctgtccgcctagcgttcgggagggcgcatgatcgccccgtgaatcccgcatggaagatgtggttgagaatcgctctcgccccccctatcatcgccgcatgacgaatcgtgacctgcccacggcctgtcaaagcaagtttgcggcgacctccaactgcatcgagtgtggtgtttgggtggatgcgttggtcatcctcggcgatatagcccattgtcccgaggatgccacctgttcccatcacgacgcctgtgcccgcgaagtcgcccggtgcgcgggcaacctgcacgagggggctccgctccgctcgcgtctgctggatcggctgcgccatctgatgtcgccggtgacggcctttcgctaggcaccgatattcctgagatacccttatcacatggaggtggacatgccgggagaggagttgtccagccgtagtgatgccgcagggtgttgtgcctccgggctgccctgtgctggctgtccggaagcggtcgcatcggtcagtcgggcatccttgggcaacggcctcagccgctcggatcaggatggctgttgggtggtacgcatcggccattcggaaaagctgcgcagcgacgatgcctgcctcgcctgctcgttctttcgcaaccgggcgcaattgctggccggatgatggcgcagggcggatatccttattttgagtgtggcttttccttgaatccgggcggcaaaggcgtaaattgccgccgtttcggcgaattcgggaaggctctgcgatgattcctcggcatgcggtcatccggtggggcgagcccctgctgcttggtgtcggctttgtggatcacgatcattgcgaggcggtggagatgatcaaccgcctggcggcagccgctccgaccgagcgtctggacttggcccgcgccttcgcccatcactgtgtcgagcacttcgcccgcgaggaggagatgatggtgaagaccggcttcttcgcccttgatccgcaccgggacgaacacatccgcgtggtcgcccagttggaagaggtgatccgcgcgctcgaggccggcgatccctgcgacgattactttacggtcgaactgccgcaatggttcctggaacaccgggcgaccatggattacgtcacctcgggcttcgcccttgaccacggctgggtggaataactacagcgtcgcggtcgcctgctccagccagtcccgctcggcggcctcggtcaattgcggcacgatcgcgtcccggacccgggcgtggtaggcgttcagccagtcccgctcgtcccggtccagcagatcctccgccaccagggcccggtcgatggggaccagggtcagggtctcgaattccagaagatcccgctcggcgccagccggggcgggccggggctccaccatcaccagattctcgatgcggatgccgtaggccccggtcttgtagtagccgggctcgttggagaggatcattccgggcttgagagccacggaattgcccaccttggagatgcgctgaggcccttcgtgcaccgacaggaagctgccgacgccgtggccggtgccgtggtcgtaatccagcccggccgaccatagcggacggcgggccaggatatccagctggctgccggtggtgcccatgggaaagaccgcccgcgccagggcgatgtgccccttgagcaccagggtgaagcgccggcgcgcctcgtccgggggggcatctcccaccaggatggtgcgggtgatgtcggtggtgccgtccaggtactgggctccggaatccaccagatacagctcgccggccgccaggggacgattggtcttggcggtggaatggtagtggacgatggcgccgttggcgccggccccggaaatggtgggaaaggacaggccgcggaaatgctcgccggtgcggcggaagccttccagggcgtcggccgcctccatttcgctgaccgttccgcttcgcgtggtgcggtccagccaggcgaggaaccggaccatggcggcgccgtcgcgcagatgggcggcccgggtgcccgccatctcgacggcgttcttgcaggcgcggggcagggcacaagggtcggaaccgggctccacccgggcgccggcggcccgcagggtctcccagacctggaagggggcggaggacgagtccagcctgacgcgctttccgccgcgtcccagcaggcgcagcgtcgcctcgaacgcggccggctcggccacgcggacggcgtcgccccacggggcggtgacagtgtcgtcgatgcggtcgggctgcacgaacagatccaccgaggcgtcggcgtaaatgacggcaaagcccagcggcagcggcgtataggccacgtcgtcggcccggatattcaacagccaggccagggattccggggcgctcagcacggcggcgtccaggcgctcccgcgccagttcagcggcgatgtcgccacgcttggcggcggcggaccggccggcaaagcgctcgggatgggcggagatgggggtggcgggggccggtggccgcccggcccataccgcgtccacgggattgtcggggcagggaaccagggtggctccggcccgctcgcaggcggcggtcaggctctggacttgatcgtgggtatgcagccaggggtcgaaccccagcctgtcgcccttggacagcacctcgcctgcccaacgatgcggcggctgctcgaccagatgcaggggcgtgaaaagctgggtgttcacctcggccagcacctgcagcgtatagcggccatccacgaagatggcggccttgtcgcgcagcaccacggccgatcccgccgagccggtgaagccggtcagccagcccaggcgctgggccgacggcggtacgtactcgccctgatgctggtcggcgcgaggcacgacaaatcccgtcagattgaggcgggccagttcggcacgcaggtcggcgaggcggtcggtgggggagggggcgggctgatgcgggctcatcctgggaatctagttcaaatggccgggggcaggtagggggaattggctttgggcgcgcggaatggttagggtgctgtcaggtccggctgttgaatatgcattgagttatattgttgcgttgcagcaacggagtttaatcgggcaaagaccctagaccaaagctagaggctggcgcagagctctttaaataaatggaaaacgtgactattctctatagtagatttgagcatgtgtttgctgtgttcaagctctcaaggtgagccgatatgggagcgcaggaagcggggccgtcccttcagtcgggcggtgccatgacccatagggagctggggggcaagcggtgccgcagcgtcgcggcggtcgccatcatggctctgaccgatatcctcgacgaggccgccgtggacggctcggtaaccatggatgacgtccgccgcgtggccaaggcggtgctggccgcccgggggccgctgtccgagcattacgccctgtgggaagatggctgtgattccagcttttccctacgccggatcgagcagcagcgcaccgatttcatgggccggatcatcgcccggccgttctccgattgcttcgacgacaagaacagcggcatcgagcgcaagcatctgccgcagttcttcgcggcggtgcgcatgatcatcggcgaggagcccttcgacctgctgcgcacccgcgccaacaaggcggccgaacgccaccgcaccgaggacggcacggtcgcttgggccgagttctatgccgatgacgaggtgcgcgccgtgttcgaggaggtcctggtcaccatggcgcgcagcttccgccgcttcgagccgcgcaaggactggttcctgatcatcatgaattccagcccgtcgtcggtgtcgacggcgtccaacgccttcattcccaagcgccccgaggacaaggtgctgcgcgaattcagtgaggcccacatggtgcggctgttccaggccctgttcgcctcgtgccggcccgacaccttctcgcccgagcgcaaggcggccttcatggaaaagtggggcagcgagccggaaaaggtgttcggatcgctcttcgtcaatctggccgaaatggcgcagtaatcggcgatgccgccaggcccaagggtttcgaagaaacccacccggcgcctgaggggcggaaagactccccctaccagtgcttgtcggcgaagacggcgatgaacagcagcagcagatagggcatggaggcggcgaagttccacccggcccagcggcggctggtgtccctgaccagtaccacgttgaagcccagcagcacggcgcccgaaaccgcggccacgaaaccgtagacattgcccagcaggcccagcccccagggcagcagcgaggcccccaccaggatcacggtgttggccaggatgcaccaggcggtacgcttggcgcccaccaccaccggcagcatgggcacgcccgcctggcggtagtcgtcggcaagcaggatggccagcgaccagaaatggctgggcgtccacaggaacagcaccagggccaggaccatgggcagcagccattgggtctgatccaccgccgccgctccggccaggacggcgaaactgccggccgcgccgccgatgatgatatttgtccaatggcggcgcttcagccagacggtgtagatggccacatagacgaagccgcccaggaacagatgcagcgccaccacccaattgaaggcggcgttggccagggccatgccggccaccatcagcaccaccgccagggcgaagcccagggccggggtgccggcgccggtggccatgggccggcgcgaggtgcggcgcatcagccggtcgatgtcgcggtcccagacatggttgaacaccgccgaggcggccgagccgagtatcatggccagggtcagcagcagcagggccaccgggtcgaccttggtcgccaccgcgccatagccggtgatggccgtcagcgcgatcatcagggcgatgcgcggcttcaagagctcgatgtattgcctgaacgtcaaacccgcctccgcgcccgcggttgctccgcaggtcaaatgtatatgtgatacagcataagatacacgacgatgccggtaatggatacgtaaagccacagcggcaaggtccagcgggcgattttcgggtgcaggtcgaactgccccttgagggcgcggaccagggtcagggcgaccatgggcgccaccaccgccgccagcagcacatggctgatcagtagggcgtaatagatggggcgcaccacgcccgttccccggaacacgaagatgggggcggcgaagtggtagaccacgtagaaggccaggaacagggctgatgcccccaccgcgcccagcatggccttgcggtggctgtccttgcggcccgcccggatatgaacgaagcccgttatcaggaaggccagcgagaccgcgttgagaaaggcggtgatatggggcagggttccggcggcggtcatgtcgtcctcaccacgtcatccagccgcccagccgcagccagattacggcgatggccatggtcagcagggtcacgggaatgccggcccgggcgaagtcaccgaaggacagtcggcacccggctccggcggcgcgttcggccacgatgatattggccatgctgcccaccagcaggaaattccccgccagggtcgacagcagggccagaccggtcagcgccccgggatcgggggtgggccacaccgccaggatcagcatcaccgccggcacgttgccgatggagttcgacgcgaccagcgccaccggcagcatggccttcagcgagtcggggaagaatccgtgctcggccagccagttgacccagtgacgcgccatgtcggtatcggcgaaggcgccggtgaccacgaacaggcaggcgaacagcagcagcaggtgccagtccaccaggccgatcatctcgcgtgagcacatgcggcggctggcaagcagcagggcggcgatggccatggcgcccacttcgcgtggcaggggggcggcgaacagcagggccaggatagccagggcgattccgcccttgaccgcctgccagcgatggccctcggccggcggatgggcctccaccggtccgggagtggcgtccagctcgcgccgccagatccaggcgatgcagtaatacaccaccaccagggacagggcggcggggacggcgcaggcggccaggaagctccagaaatccagcccgcccacctgtccgatcagaatgttctggggattgccgatcagggtggcggcgctgccggcattggcggcgcccaccagccccagcagatagggacgcggatcgaggccgcgccgacggatgccctcggcgatgatcggggtcatggcgaagcagaccacgtcattggccagcaccgccgacaatccgcccgacaccgccaccaccagggccaacaggcgccgggccgaaccgggcgattctgccaccttctgcgccacggcgccatagaccccggccagctggaactgggccgagacgatcatcagggcgaacagcagcagcagggtgggcacgtcgatggaggtgcccatggccttgacgcccaccttgcccgacaccagcaggaccaccacggccagcagggcgatgccggtacggtcgagccgcaggcctggcaccgagccgaaggccatgccgagataggtgaggaagaagacggcgatgacgaaactatccatgccttcccttatggcctttcggcggagcctcggcaagtcccgccgtgttgtcttcgctattggtgcggcgccggtgtatctatcaatgtcgcaacattggggggcatgtgatggttggattcggttgggtgcgcttgagccgcatggcggccatggtcttggtgctggtcttcggcctggggagcgtcgtcatggcggagacggcgccgccgccgtccgacggccggatctacgagtttccccagcccaagccggccgacgccgtcctcatcaattcccgcagcggcaagcccatggcagtgacctattggctgcaggcgcgggtggcctcgcctcaggatctgtccaccatccgggccatgtccgaccaactgagccggcaattcgcccggctggtgggcaagcatcacctggaggatctgctttccgtggagcagaagcgggcgctggccgacaagctggtggtggtcgccaacaacgagctggcggcctatgaccgccgggccggcgtggcggtgccgtccgaccgggtctatgtggaggccctggtattcaaggaattcagcatggaggcggtgaagtaggggccccctacttcctcggcaatcccgccgcgatgcggtccatcagcgcgctgggcaggcaccccgccaggcgggccatcaggtgcatgggccagggaaaggcgatgcggccccggttgcgggccagtccgcgaaccatgatgcggctggcccgctccacgtccatcaggaacggcatgcggaaccggttcaccgccgtcatgggcgtctccacgaagccggggcagatcaccgagacgccgatgccggcgggggccagctcggcgcgcagggattcgccccagaccctgattgcggccttggaggcgcaataggcgggcgctccggcaaagccgcgaaagcccgccagggaactcatgatgccgacctgcccccggcggcgttgccgcagcaggggaatggcgggcatcaccgtgttgaacacgccgttcacattgacggcgaagatggcccgggtctgggcctccgtctcgccgccgccgccggtgcccgccgagatgccggcattggcgatgaccagatccagcggccggatggcgtcggaatccgtgacccagcgcgccgtggcggctgaatcggtgacgtccaacggggtggcgtggacagccgctcccagcgcttcgcactgcttcgccgccgcgtcgaggcggttccggtcgcggcccgacaggtgcaaggtgacgccgggcgccgcgcagatccgcgccagcccggctcccaggcccgacgaggcgccggtgatcaggacggagctgaacggctttgtcatccgccgttgccgttcccgttgccattgccgttccgctcgttgagcagggcgcgcagcggccccagcaggggcggcaggtcgtggcgggcggtgtcgaagatgatggaggggtcgacggaatggtattcgtgcaccagaatgttgcgcatctcggacatgcggctccacgggatgtcgggatggcgttccagcacgttgaagggcacgcgcttggcggcctcaccgatgatttccagattgcggaccacggcgtccaccgtgcggtcgtcggcgacgaaacggcggtcgtccatgccctcggtatagcgccggatgcgctcgatggcctcgatcatgtcctcgatgcggacccgccaatccttgaaggtcaccgtctcccgtctccctctccgtaaaccagcaggcattcttccaggatgcgctttttcaggcgcggcttgatgttgcccgaggtgatgaggtccaccgggcggccgagaagcccttccagggcgtgcttcagctccacataggcgaacaggccgccgggcttgccgggaaagaactcgaccatcaggtcgatgtcgctggtgggcttggcctcttcccgcaccaccgagccgaacaggtacaggttcttcaccccgaagcgttccatgatgtcggcgcgcgactgcaggcggccgatcacctcctcgcgcagggcggggctgcggcggcgcgagatgcgtccggcataggccttgaccgcgtcggccttgtcggccggcacgcgcaccacgatctcgatgacgttggggcggccgcgttcgggccgtcgtctttccttcatgactctccaaggatagtcccgcctcgggtcggagggaaagcacggttgttgcccaggcccggcaaggctataaaaccctccggacattttgcaggaggttcccgccttgaccgtcgccagcatgaccggctacgcccgcgccgagggccgcgattcccagggctcctgggtgtgggagggcaaaagcgtcaacggccggggcctggaattgcggtgcaaatcggcgccgggctatgacgggctggaggtggtggcccgcgaggcggcggccaggcgcctgaagcgcggcaacgttcaattgtcgctcaccgtgcggaccgagaccgagcaatcccagattcgcgtcaacgaggcgctgctgagccagctcgtcgccatctgcgaccagtggcagtcccgcgccggctcggtccagcccgcccgcatggacggcctgctggccatcaagggcgtgctggagccggtgaccgaggccgaggtcggcgatgccgattccctgcgggccgcccgcgacgaggccatgaaagcctcgctggaggccatgcttgaccagttggccgccatgcgccgggtggaaggcgcccgcatcgccgccgtgctggctgcgcaactggacgagatcgccaccctgtcggcccgggcgggcaattgcgccgtgctgcgccccgaggcggtgcgcgagcgtcttcgcgcccaggtggccctggtgctggaggcggcgcccaccctggccgaggatcgcatcgctcaggaagtggcgctgatcgccgtcaaggccgatgtgcgcgaggaactggaccgtctggccgcccatgtggccgccgcccgcgacctgctggcccagggcggcgccgtcgggcgcaagctggacttcctggcccaggagttcaaccgcgaggccaataccctgtgctccaaatcgtcggacgtggaactgacccgcgtcgggctcgacctcaaggccgtcatcgaccagttcaaagagcaggtccagaacatcgagtaggaaccatgaccgatacccttcccaccgtcagccgccgtggcctcatgctggtgatgtcgtcgccgtcgggcgccggcaagaccaccatctcccgcgccctgctggaacgcgatcccgccatcggcatgtcggtgtcggccaccacccgggcgccgcgccccggcgaggtggacggcaaggactaccacttcgtcacggtggagaagttccacgagatggtggaaaagcgcgagttcctggaacacgcccgggtcttcgacaatttctacggcacgccgcgcggaccggtggacgagatcctgcgctcgggccgtgacgtgctgttcgacatcgactggcagggcacccagcagatggcccagaacgcccgggccgatctggtctcggtcttcgtgctgccgccctcggtggaggaactggagcgccgcctcaggggccgcgcccaggattccgacgaggtggtgagaaagcgcatggccaaggccggcgacgagatgagccactggccggaatacgactacatcgtggtcaatatcgatctcgacaagtccatcgccgccgtccaggccatcctggccgccgagcgcctgaagcgcgagcgtcaggtgggcctgcccgatttcgtcacccagctgcgcggcggggaatagcccgaattccgagcgcttgtcaggccgccgcgcgtgccagggtctggtcgcggatgggcaggtgcaccagggcggcgaagaggcccagaacggcggtgccggcccacatgacgtcgtaggacaaggtggcgtcgtagatcaggccgcccagccacgagcccaggaagctgcccagctggtgggtgaagaacaccagcccgaacagcatgcccaggtacctggggccgaacacgctggcgatcaaagtcgaggtgggcggcacggtggacagccacaacaggccgatgctggcggcgaaggccagcagggtccactcgttcttgggtcccatgacgaaggcgaaggtgaccacggcgcggcccagatagatggccgacagcacgtatttgggccggtacttctgggacagctggcccatcagccaggttccgatcacgttgaagccaccgatgaccagcagggccgtggcgccggcccccttgctcatgccgcacagggccaggtagccgggcaaatgcacgccgatgaaggtgacctggaagccgcagacgaagaacccggcggccagcaggcggtagccgggatggccccaggcctcgcgcagggcctggccgatgctttggtgcgccagggtcgaggctgcgggccgcgacgccttctcccccttggccaggaccagggccaggggaatggaggccagggaaaaggccgacagaatccacacggcctgggtggggccgaaggctccgatcagccactgggccagggggatcatggccatcatgcccagcgaccccagggccgagcccatgcccatggcggaactacggtgctcggggctcaccgcccggcccacggggccgaggaccacggcaaagctggtggcggccaggccgaagccggacaccacccccaggccgatcgtggtcagcgcaaccccgcccgctccgaccatcatcatgcccagtccgaaggtcagcgccccgaaggcggcgaccttggccgcgccataacggtcggcggcggcgccggtgaacggctggaagaagccccacatcaggttgtggatggccaccgccagggaaaaggtggccagcggccactggcgttccagcgacagcggcccgatcagcagtccctgggcctgccgggcgcccatggagacgctcatcatcatcgcaccaccgatgaagacgagcacgatggcgggcgacagccaggcgggacgcgacatgatccgttcaacctttgatcggtggcgatgttccgacactacggcgtgtcggtcgggcggcgcaaacgagatttgctcaggcggggagttaggaaatctaacgggctggggaaaaactccacttcgggggcttttgcccccgatctcccaaccgggaagcacggcttcccggacccttcagctttttaatccattgaaataaagaaaaactggcggttcggaggctgtgcctccgaacgggtctgggcggtagccctgccgcgaagcggggctttttccaccagcccgccaatgccgtcccgggctcagaaatcgggcgtcgccgcggcggggggcggcgggggaggcggcggcatccatccgccgccggcgccgaagaccgccagggcggccaggaccagggccacggccagggccgcaacgccgccgccgctggccgaccggcccggcccgtccttccgtccggtcagcatggggccgatcaggttctgcttgcgcaccagggcatagaaaaccatggcccccacatgcacggccaccagcaggtagatgagcttggacgccagatgatgcacggcggtgaggccgttgctcagggacttgccggccagatcgtagagcgggccgcgaaaggcgatgtcgtcattggcgaacagcccggtggcggcctgcagcgacaggatgcccagcaatccgaacaccgccagggcgcccagcgggttgtggccttcgccatgccactcgccgcgcagataggcccggacggcccccggcgtggggacgaactgggcaaagcgggcataggtcgatccgaccagaccccaggccaggcggaacaccagcaggccgatgatggtcaggccgatacggccgtgccaggccatcaggccgccgcccaactggccgctgaccgaggcggcggcgacggccagcaccagggaccagtggaacaggcgggtgggcaggtcccacaggcggaatttctgctggctcatggcgtgcctcgggcggcggaagcggaacaggcgcccgaaggcgcctgtgttgggaccagacccagcctactgcttgatcttgaattcgtcgtggcagcccttgcaggtggcggccagcttgccgaactgctccttggtggcggcggcatcgccggcggcggcgaccttggccatctcgttggcttccttgccgaaggcggtggccaccttgcccagggtctccttgttggtccagagctcgggcttgacgcgggtcttctcccagccggtgccggtatcggtgcccggcaggtaaagggcgcccatgcccgaattggcgacggcctggatggcgttggcggccttgatgacctcgtccttgttataggcggcgccttcgacgttcatcttgatgcgggtcatgttccaggccatgaaagcatagccggactggcgccacttgatggcgtcctcgggcttgacctgggcggtggcggtgcccgccagggcgacgagggcggcggcggtgatcagaagcttgaacttcatggcgaggtctccgaagggctttggggaaagagaacttgcagtcaggctatctaatataccccctcgcgtaaattacgcatcgggtaacagattgtttcgtcctcatcgacaaatgaggacgattttccccgtggcggcgcggcccttcagcaatccgatggcctctaccgcctgggacaggtccatgaccttggagacatggggcgacagcttgcccgccgcccaccagtccaggcattcgcccagggaatcgcggaccatttgcggcgcaatcttgcggtaggcgccccagtaatagccgatcaccgtgacgttcttgaccagcaggatgttggcggggatctgctgcaccgtgccgccggcaaagccgatgatcagaatgcggccgtcggcggcgatggagcgcaaggacgcgtcgaacacctgtccgcccaccggatcgtagaccacgtcggcgccccggccgtcggtcagggccttgacccgctcgcggatatcctcggccttgtagtcgatgccgaaatgggcgccgtgctccagcgccaccttgaccttgtccggcccaccggcggtgccgatgacggtggcgcccagcgcccggcccacctcgacggcggtcaggccgacgcccccggccgcgccgtgcaccaccagggtctcgccggatttaagccccgccttgcccttgaggcccagatgcgaggtgccgtaggccacgggaaaaccggcggcggtgacgaaatcgaggccgtcgggcagcacatagacgtcggtctgatcgcacaccgcttcctcggcgaaggcgccgccggtcactgtggccatcacccggtcgccgggcttggccgtggtgacgccgtcggccacctcggtgaccacgccggccagttccatgcccggcacgaagggcggctccatcttttcctggtacttgccgccggtgatcagcgagtcggcgaagttgacgccggccgcatgcacggcgatgcgcacgccgcccgggatcatggcgggggcgggaaagtcggtgacgaccagatcctggccgaaagcggggcagacgacggctttcatgagattttcccggaatggcgggttgcagaagtgtctgtcatcccgacgaccaacgggaggagggatctccgtctggaacggcgtgtcccaaccggcaccgtatcttcgggcggagatccttcgcgttgctcaggatgacgggaaagggcatggaaatatcaggcggtggcgcggcgggggacgcttttctgggcggcccaggcccgcttcaaggtggtgaacaggacgatctcggtgatctggtcccgggtcatgccgcacgacagctcgccctgggcgaactggaccagctccaggggggcggcgttggaggacagcaggttggtcagcaattccttgcgcaccagcggcggatacttcatcacctcgcgcaccagcgagaccttgaccatcagcgggatgttggggctggtgaacagccggtcgacgcacagggcgtagatgccgaaatccagcttgcccgccacgctgcgggtaaagtccaggaactcgtccaggaaggacggctcggagatcttcttgtcgatcagcagcttgatcacgtcgagaaaggcgcggtagcgggtgcgcgccggtcccacattgccgcccagttcggcggccagctcgcggatgcgggcctcgcggaagccggcggtgatcatggcctcggccgagccgcgcaccccggaatcgaaggcggtctcctcgatcagctgaaacagctgctcgtatttgggccgatggcgggccgagaccttggaggcggccaccgacagcggcagcatggcggccagcgccacctgggaatcgcgggccacgatggcggccatggacagggccgccacatcgcccacggtgccgttcagcagatcgtcggtgatgaccagccgctcgcccggcgccaggctgagattggtgttgagcgccccgcattccatgaaatgcgtcgccagatcggacggtctggcggcaaggggattggcaacgggggcgtatgtagtagccatggttgcattcagccacaatacccgccggggggcaagagtctcgggtcttcaccgtcttttcctgggcgccgcgaagtgctaggatgcccgatctggtctgcgtggaattgttgaaaccatggttgagtccactcgcggcttcggctcgtcggcattgaacaacgcggtctccgggatccgcgacgcgttcggccgcgaccagcgcgcctcggtcggggccggcggcggcgaggcggtgaccgccatccagggcgccacgcccaacggcccgcgcggccggcgcatgctgtcgcccagcacctcggtggacagcctggaccgcagtgcgccgcggggcacttatctcgacatcctggcctgatgaagccttccggccccgttctgcgcaccattcccgaaggggatgaccgcgagcggctggtctgcggcgattgcggcttcgtccattacgaaaaccccaagatcatcgtcggcgccgtctgtacctggggggatcgctacctgatggtcaagcgcgccatcgagccgcgccagggcacctggaccatgcccatcggctatatggagctgggcgagaccaccgatcagggcgccctgcgcgaagtgtgggaggaagcccgcgccgtggccgaggtggacggcctgctggcggtattctccttcccccagatcagtcaggtccacatgatctaccgcgcccgcatgaccagcccggatttcgccgccgggccggaaagcctggaggcggggctgttcacctgggacgatatcccctgggatcatctggcctatcccaatgtccgcatggcgctggactacgagcgccgggtcaagggccagagcgcctttccccccatcggcttatagggtcttcgactcctgctccgcctcgtcatggctagccacgtcgcccgcccgggcgaacatcttcgccgcggcgtgcatggccttgcgggcttcgtcccgccgcccctcggcggccaggatgcgggccatcaggcgcgacgccttggcctcgcccagcagattgccggcctcgcgcatcaggcccagggcctcctcgcactggggccgggcctggtcgggatggcccagcgccagctgaatcgccgccatggccttgagggttcccgcctcgcccagggtgtccgacgagcggcgatagcaggccagggcctcgcggtaacggtccagcgccttgtcctgggcgccgccgtcgcggtccaggtggcccaaggcgcggtggacatggcccaggcccgaggactcgccggccgagtcatagacctccagcgccgactgatagagggcgcgagcctgggtctcgtcgccctcgcgctgggccagatgggcgaggcgcaccaggacggcgccctgctcgcgctggtcgccgccgcgggcatagagctggcgggcctccacataggcctggcgggcgccgttgccgtggccggtctcggcctcgatgtcgcccatgcgggtcagggcatcggcctcgccgcgcacgtcgccggtctcgtgatagagcaggcgggcccgcaggcagcactcgcgggcccgctgcttctcgccggaaagccacagcgtctccgcttcatcgagaacatggtcggcttcgctccgggtcatggcggcccccccctttttccgaattgtgacgcgttcagcgtaaacttctatccgagcgctaccaaatattccttttatgtgggcatcagggggaataaaaatcgtctatgaggttggttctgatccttgccgtgttcgccctgatccgccctgtggaggcgcttgccgccgactgcacccagccggcggccccgggggtggattggcagcgctgctacatggatggccgggacttttcccggcacgacctgagcggggcgcggctgcgcgagaccagttttcagcgcgccaggctggacgggacggttctggccaaggtggacggttatcgggtgcggtttatcagcgccgctctggtcggcgcccgcctcgacgacggggtcttcagcgaggccgatttcaccaaggccgacctggggggcgcttcgctggcgcgggccgatctccgccgggcgcggttctatcacgcctcgctgcgcggggccgatctgacgggggccaggaccctgggggcggaattgctgaacgccgatttgtccggcgcccggtggacggacggcaagaccatttgcgccgagggctccctcggccagtgcaattgaggttcaggtaacgatgaagagtccggatacccttgatgtcgccgcccattgcgcccgggcggcgctggccatgatggagcggcacaaggtgccgccccatcccgagaattacgccatctggtacgcctatgtggccgggcgcaatccggacctgaccgccgccatcgacgccatcttgcaatcgggcaagaagttcacagccaaggtcaatgacgaactctacgagcgctttgccgtcttcccccaggacactgccgaactgcgcgaagtgggccagcgggtcgaggaggcggtggggcgcgtgctggaatacctgagcaacgccaaccagggcaccagcaattacggcgcagccctggaggatttcagcggcaagctggccgacgggccgtccgccgccgggttgtccgaactgatctcgggcatcctggccgagaccaaggtgatggccgatctgaaccggcaactggaacagcgcctggaaaactcgtccaacgaggtggcgcggctgcgcaaccacctggacgacctgaagcgcgaggcctccaccgacgccctgacccagttggccaaccgcaagctgttcgatcactcgctcaatctggcggtgctcgacgccagggcggcggatgcgccgctgtcgctgctgatgatcgacatcgatcacttcaagcagttcaacgacacctacggccaccagctgggcgatcaggtgctgaagctggtggcgcgctcgctctccgaggtggcccaggccaaggataccgccgcccgctatggtggcgaggaattcgcggtgatcctgcccgccacgcccctggagaagtccatggaggtggcggaaaccatccgcaatcaggtctccaccaagcggctgaccaaccgtcgcactggtcaggtcctgggccaggtgaccctgtccatcggcgccgccctgcttcgggaggccgaggcccccgattccctggtccaccgcgccgacgaggccatgtatctcgccaagcgcgacggccgcaaccgggtgaagagcgagatcgacctggaaaagccaacgggcgaagcggcgaaatagatgcaccgctggacccgccatgctcccgcctgtattactgctggggcgcgcggccgggtggggacgcggccaacgcaggtgtattgcccaagatgattctcgaacgtcgcgtcatcgtctttccccgggctgatttcctcgacgccatccggcgctatggcgagcggatcggcaagatgctgccggacaccgccccggatctgctcagtttcgatcccgcccaggatatcgctctcaccatccgcttcccggcggtgttcgccggcggctcggccaaggacttcatcttttcccgcgatgatgtggggcaggcgctgaccctttactgccgcgagcgcaaggtgccgctgcccaagaattccgccaagcagatcgagaagttcaaggacggcgcggcgctgaccatgcagatcggcggcgccggcctgcacatcatggtcatcgacgaccaggaagtgatgcgcaacatcatcaagaagctgctgggcaaggccaatcccgcccagatctccgaggccaatgacggcctgacggcgctggagatgctgcgctcgggcgacgtggaccccgacgtcatcatctgcgacctgcacatggagcacatggacggcatcgagttcctgcgcaccctccggaacgagaagggcaatctcaacagccgcaagccggtgctgatcctgaccggcgacaaatccgagcaggcgcacgagatcacccgtcaggtgggcgcctccaaggtgctgaccaagcccatcggcgccgacgacctgatccgccagatcaatctggtgcgcggtcatttcgaggccggtcggccttagagcggccattgaggccgcggccaagcaagccaaaggcttgcgcccggcgagggactgacagaaactgagatcatcttgcgccatatcagacgctcgatgatctcaggatatccgggggggggacggcgatggggatcttccgctattgccgcctggcccttcgcagcctgcagatcctgatcgagcagtttccggttttcctccgcctgtcctggctgtgcatggtggtcagcctgctgggggtggcggtgtcgtcgcgccatgtgatgaccggcggcatcaccgacctgctggcgcacggcgtcttcgtggtggcctggctgcgcatggtcggcctgggcgagattcccgccagccgccattatttccgcctgggccgccgcgagaccttcggcgccctgtcctggatggcggcggaaatcttcgtcaattttcccgcccaggtcatcgccgcgtcgctggccattgccaccggcgtgcccatcgccgattcggtgatggtgctggccgggctgtcccatctgctgctggggggcttctatctggtgccggccgacgcggcgctggaacgggcgggcaaaaccggcgatctgggttggcgggtgcccgacctgatgatccgcggcggcctggccctgggggtggcggtgttcgtctgctggctgccgttcaatctgctgcaggaaggggtgaggctgctgcccgagatggatctggccgacggcctgtccttgcgcgacgccgtcatggtgccggtgcgctatctgggcatggccctgaccgccgggaccctggccctggcctggaaccggctgatggtcgaggaaacgggcgggtagccggagggcttgaaggcggggctcccgccccggtccccggttggaggcgatgcctccaaccctctctttcatttgcaaattgaaagtgggggctcgccggaattatgttctggcgcgcaggtccgcgatgccttcgcgggccagggcgtcggcgcgctcgttctcgggatggccggcatggcccttgacccagtgccacgacaccttgtgccgggcggcggcctcgtccagggccttccacaggtcgtcgttcttcaccggcttcttgtcggcggtcttccagccccgcgccttccagccgcgcagccattcggtcatgcccttcttgacgtattcgctgtcggtgtagacgtcgacggcgcaggatcgcgtcagggtgttgagcgccaccagcaccgccatcatttccatgcggttgttggtggtcgggctttcgccgcccttcaactccttctcgatgcccttgaagcgcaggatggcgccccagccgccggggccgggattgccggaacaggcgccgtcggtatagatctcgacggtctcgggcttgggagctgtctcgctcattcgatgccgtactggcccgggccggtgacgccctggtggaagcggagcttgcggtaatattccatggggtccttgcgcttgaccatggcgccgggcggggtgtgcaaccagtcgtagctgcgcgtcagcaggaaacgcatggctgcgccgcgggccagcagcggcagggcgtccagctcatcggccgacagcggacgcacccggcgatagccgttgagcatcaggcgggccttggtggcgttgaaggcgccatcctcctcgaagcaccaggcgttgaggcagatggcgatgtcgtaggccagcacatcggtgcaggcgaagtagaaatcgatgaagcccgacatgcggtcgacgcccgccgccttgtcggccaggaagaatacgttgtcgggaaacaggtcggcgtggatcagccccaccggcagggtcctgggccagtgggcctccaggtagtccagttcgtcctcgatgctctgcgccagatccgacttgatctcggcggcgcggggccggatggactcgaacagtggccgccagccggcgaccgacaggttgttggcccgggtcaggggaaaatcggcacccgccaggtgcatggtggccatggccggacccagctcggcgcagtggccgagggtgatgcggcggctccacatgcccttgaggaagctgacgatggccgccgggcggccgcacagcgtgcgcagcgccttgccgtcgcggccatggatgggtgtggggcaggctaggccgtgggcggccagatgctccatcaggcccaggaagaacggcagctcctccgggttcacccgcttctcgtagagggtgaggatgtagttcccctggtcggtctgcagcaggtaattggtattttcgacgccctcggcgatgcccttgcacgataccacctgaccgatgtcgtattcggcggcgaagtcttccagttcgtcgtcggatacctcggtgtagacggccatgctctctcgacttggtccagggggggggaattgggcggaaggtacgatgtttccgccgatgatgccagcggagagaggcggctttccccatgtcccaaggatgtcatcccgacgaccatcgggaggagggatctcgttctgacgcggcctttcaggatcggtatcgtcgcgccagacggagatccctcgcatgcgctcgggatgacaaaccctgccggggcctattccgacagggcctggggcagcttgaaggtgaccgtttcggtggtgacgcggatttcctcgatggtgacgtcgaagcgttcccgcgccgccgccaccacttcctccaccaggatctccggggccgaggcgccggcggtgatgccgaggcggtcgacgccgtccagcaggctccaatccacctcggcggcgcgctggaccagtaccgagcgggcgcagcccgcccgcgccgccacttccaccagacgcgacgagttggaggaattgggcgagccgatgaccatcagcgcctcgcaatggggggcgatggttttcaccgcggcctggcggttggtggtggcgtagcagatgtcctcgcgcttggggccgaccatgtcggggaagcggcgctgcagcacgtcgatcaccgccgccgcgtcgtccaccgacagcgtggtctgggtgatgtaggccagcatggacgggtccctgggggcgacggtttcggcctgctccggcgtgccgaccagcagcacggtcccttcgggaacctggccgatggtgccgatcacctcggggtggccggcatggccgatcatgatgatctggcggcccatggcgtggtgcagctcggcctcgcggtgaaccttggtcaccagcggacaggtggcgtccagcgaggtcaggccccggcggtcggcctcggctggcaccgtcttgggcacgccatgggcggagaacaccacggcggcctcgtcggggacctcgttcagctcctcgacgaacaccgcgcccttctgggccagggattccaccacgaaccggttgtggacgatctcgtggcggacatagaccggagcgccgtatttctcgagagcccgctcgacgatgtggatggcgcgatcgacgccggcgcaaaatccgcgcgggctggccagaaccagggtcaggggcctcttggtaacgcttgtgctcacggtgtcgctctccggaatggcggggggtacggggttggcggcttgtatcggcgcccaggcttcactacagtcaggggcacctttatcagatcatgtggctcttaaggaagtttggcatgaacaccccccgcattgcccgcctgttgtttttcgtcctggcggctcccctggcgctttcggggtgtgattccttgagccgggtcaagaacaagacgccgccgccctgtccgccggtctacatcatgtccgacgccgccaagatcaccaagtatcgccccggcggcggccgcgacctgaccgacgtggagatggaaggcgagatcgtcgctttcaagggggattgcgtttatgacgaaaagggcggcgaggtctcgctgcagttgggtttcgagctgcgtcgcggcccggcggccaccagccggacgctggacgtcacctatttcgtcgccgtgccgaaattctacccggagccctcggccaagggggtgttcaccttcccggtgaccttccccgatacggtggatcgcctgcgggtgaccgatgacgaagtcaccatgcgcttgccggttcggaccagggaactcattgataattatgagatctacctcggctttcaactgacgcaggaagaggtcgaggccaatcggcgcgccaagcattagggagtcgactctcgttgactccgacgccggcctgactaagatgtgcccgcacagatgatccccgtgggagagatcggcccctgacgattgggccggcgccgaaggagcaaccgcccctggaaactctcaggcaaaaggaccgcggggggatgaaactctggaaagcgtgccgcgggaccgtctaaggtccggtggcccaccgacgatgaaagccgcgaagccttcttgggtcttgcggtgaatctttcaggttcccagacagaggggggcaagccggacaacgccacagccgcgtccggagcccttcaattcccgcgcggcggagccgcgaaggaggaacccggtgacccagtccgagactcccatgctgaccgttcccctggatgccctgcatcgcgaattgggggccaagatggtgcccttcgccggctattccatgccggtgcagtacccggccggggtgctggccgagcatctgcacacccgctcgggcgccgctctgttcgacgtctcccatatgggacaggcgtccattcggggcgccaaggcggtggaactgctggagaccctggtgccgggcgacatccaggccctgggactcggcaagacccgctacagcgtcttcaccaacgaccagggcggcattcttgacgacctgatgatcagcaagctggccgaggatcacctgttcctggtgatcaatgccgcctgcaagcatgccgatttcgcccatctcaaggcccatttgggcgacaaggtcgagctgtccatgatcgaggaccgctcgctgctggcgctgcaaggcccgggtgcggcggccgccatggtcaccctgtgtccagaggccggggccatgaccttcatgaccatcgccgagatcaccgtggccgggatcaagtgtctggccacccgctcgggctataccggcgaggacggctgggagatttccgtggccaatgccgacgtggaaacactggcccgtgccattctggcggcgccgggagtgatgccggccggtctgggggcgcgtgattcgctccgcctggaagccggcctgtgcctctacggctcggacatcgacaccaccaccaccccggtggaggccagcatcgcctggatcatgagcaagcgccgcagggccgaagggggcttccccggcgcggcggtgatccagaagcaattggccgagggcgcgccgcgccgccgcgtcggcatccagcccgacggcaaggcgccagcacgcgcccataccgagatcaccgacgaggcgggcaaccgcctgggcgaaatctgttcgggcggcttcggcccctcggcgggtggcccggtggccatgggctacgtgcccgccgccttcgcgggcgtcggaaccaagttgaagctggtggtgcgcggcaaggccatggacgcccatgtctgcgacctgccgttcgtgccgcatcgttatttcaaaggctgaggggaactccaatgagcagcaagcgtttcaccaaggatcacgagtggatcgaagtcgacggcgacgtcggcaccgtcggcatcagcgactatgcccagcatgccctgggcgacgtggtgttcgtcgaggtgcccgagccgggccgcgtggtggccaagggcgccgaggccgccgtggtggaatcggtcaaggccgcgtccgaggtctattccccggtatcgggcacggtgaccgccggcaatcaggccattgtcgatcagcccggtctggtcaacgaagccgccgagggcgccgcctggttcttcaagctgacgctcagcaatccgggcgaagtggccgacctgatggatcaggccgcctacgacgcctatctcaagaccctggaataggctctgccatgcgctacctgccgctgaccgaggccgaccgccgcgccatgctggacgtgatcggggccaagagtgtggacgacctgttccgcgacgtgcccccatccgcccggctggccgggccgctgccgcttccctcccaccagggcgagatggaggtggagcgcgccttcacccgcatggccggcaagaacctttcggcaggctgcgcaccgttcttcatcggagcgggcgtctaccgccaccatgttccggcggcggtggaccagttgctgctgcgcggcgagttcctcaccgcctataccccctaccagcccgaggtgtcccagggcaccctgcagatgctgttcgagttccagagccaggtggcgaccatcaccggtatggatgtggccaacgcctccatgtatgacggcgccaccgcctgtgccgaggccgccatcatggcgtgtcgcatcaccaagcggaaccgggtgatcgtttcgggcggggtccatccccattacgccgagacgctggaaacctcgctgcgcttcaccgagatggaggccgatgtcctgccccccgatcccctggggatggaggacatgatcggccgggtggattccaagaccgcctgcgtggtggtgcagaatcccggcttcttcggcacggtgcgcgatctgcggccgctggcggcgctctgtcacgaggccggcgccctgctggtggtgatggtggccgagcccaccagtctcggcctgatcgaatcccccggcgccatgggggccgacattgtggtctgcgagggccagagcttagggatgggcctgaatttcggcgggccgggcctcggcctgttcgccacccgcgacaagtatgtgcgccagatgcccggccgtctggtcggccagacggcggatgtggacgggcgcaggggctgggtgctgaccctgtcgacgcgcgagcagcatattcgccgcgagaaggcgaccagcaacatctgcaccaattccggcctgtgcgccctggccttctccatccacctgaccatgctgggcggcaccggcttcgggcgtctggccgagctgaaccatctggccgccaccaggctggagcagaagctccgcgccgtgaaggggctgcgggtcctgccgcaaagctattacaacgagttcgccgtgcatctgggcgacgacgccgacgcggcggccgtggtcgacgccctggccgacaagggtatcctggccggcgttccggcgtcgcgcttctaccccacctggccggagttgaagccagtgctgatcctggcggccaccgagaccaataccgaggacgacatggaccgcctggtggcgggtctgcaggaggttctgtgatggctgagatcaataccatcagcggcaatcgcgcccttcagatcgaagagaagctgatcttcgagctgggcaatcccggctctgtcgccgtcgacctgcccgagccggcgcccttcgatctggagcgtctgggcgacgcgccccggcgcggtcgggtagcgctgcccgacctctccgagccccaggtggtgcgccattacacccggctgtcccagaagaattacggcatcgacaccggcttctatcccctgggctcgtgcaccatgaagcacaatccccgcctgtccgagaaggtggcccgcctgcccggcctcgccgatctgcatccgctgcagccgcaaaagaccgtgcagggcgcactcgaggtgatcgacaccctggcccattggctgaaggcgctgaccggcatgccggcggtggccatgagcccggcggccggcgcccatggcgagtggtgcggcctgatggccatccgcagcgcccacgaggacaagggcgaggggcaccgcaagcgcgtgctggttcccgaaagcgcccatggcaccaacccggcctcggcggccatgtgcggctataccgtcgatcccattccggccctggagaacggccgggtggatctggcggcgctgaaggccaagctgggccccgacgtggcctgcctgatgctgaccaatcccaacacctgcggcctgttcgagaccgagatcgtcgagatcgccgcggcggtgcatggggccggagcctatttctactgcgacggcgccaatttcaacgccatcgtcggccgggtgaagatcgccgatctcggcatcgacgccatgcacatcaacctgcacaagaccttcgccaccccccatggcggcggcggtcccggtgccggtcccaccgtgctgtcggctgccctggcggccttcgtgccggtgccctatgtggtgcatggcgccagcggtctggaactggtggagggcaagcgggacggcgccaagccgttcggtcgggtcaagggcttccacggccagttcggcgtgttcgtgcgcgccctggcctacattcagtccatgggctcggacgggttgcgtcaggcctcgtcggatgcggtgctcaacgccaattacctgctggcctcgctgaaggacgagctgtcggcttccttcgacggtccctgcatgcacgaggcgctgttcgacgaccgtttcctcaaggataccggggtcaccaccctggacttcgccaaggcgatgatcgacgagggctatcatcccatgaccatgtacttcccgctggtggtgcatggcgccctgctgatggagcccaccgagaccgaatccaaggatacgctcgaccagttcatcgccgtggtgaagggccttgccgccaaggccaaggcggggggggtggaggacttcaaggcggcaccccggctcactccccggcggcgcctggacgagaccctggcggcgcgcagccccgtgctgcgctggaagaccgccgcggaataatcggtcatgtgaagggcggggaactttccccgcccttcatcacattgcgcttcggaattgcactaacactcacttgctccccgccaacctttgtcctaggctttcatgctggaatgaggggaatgggaatggcggacaaggacgatctcggccggtcgagcgatatgtatgtcgctttcgctttcgcggcggccgacgttcttttggaactcgatacccagggcaacaccatgttcgccgtcggcgccgccatggcgctggtggggcggggcgccaaggcgttgaccggacagcccctggtcaagatcatccatcccagcgatcacacggcgttgtcccaggccctgaagcagatggcggggggcgagcgggtgcgcaacgccgtgctgcgcatcctgcgcccggacggcaaggcatcggaagtgaccatgtcgggctatcgccatcccagcgtgcccgaccggctgatggttgccctgggacatcccggcggcttccacgcccacaaggaggatcgggtcggcgagaccgggctgctggacaaggacagcttccaggccatggcggccaacctgctggaaagcgccgcgccggatgatccctatcagctgactctggtcgagttgcccaagatcgacgcgctgtcgggcgacagcgcggcgcaggaagccctgaccaccgaactgggcaatcgcctgaaggcgctgtccgtgggcggcgacgcggtcggccagttggacgagggcaagttcggcgttctgcactcggcggcggtctcggccgattccatcagcaagtcggtgacccaggcggcggccgtggtgctgcccgatgcgccgcccattcaggcgaccctggccaccttgatgctggacgtggccgacgtaccgccggaggaagcggctcgggcgctgacctacacgctgaaccgcttcgccctggaggcggagaacggcggcaatctcgccgatttgatgaaggatctgcagccccgcctgtcggccacggtcaagcagatgaacgacgtgcgcaacacggtgaccggcggcgatttcgacctgatgtttcagcccatcgtcgatctgtggaccggcgtggtgcaccatttcgagtgtctggtgcgcttcaagggcgaggacaacaagtcgccctacgagaccgtgaccttcgccgaggataccggcatggtcggcatgctggacatggcgttgctggaacgcgccgtcgccttcatgcgctctagcgtcgccaataatgattccctgaagttcgcggtcaacctgtcgggctattccctgtccgatcccacggtggtccgccgcctgaaggaaatcctgaccaccaccgccgacctgcgcaagcgtctggtgttcgagatgaccgaatccgcccaggtccgcgacctcaaggcggtcaacgacgtgatccagatcatccgcaagcaggggcacgaggtctgcctggacgatttcggcgccggccacgccgccttccactatctgcgcgccctgaaggtggataacgtcaagatcgatggctcctatatcaaggacgccatgcgcagcaacgaggacgtctcgttcatcaaggccatcgtcgggctgtgcaccgaactgggcgtcaccactaccgccgaatacgtggaggatgccgagaccgccaacctgctgaagctcctgaaggtccgcttcggccagggctggtatttcggcaagccgctgcgtccgtcctccgacgacatccgcaccgcctggcgcactccgaccctgggttggaacaaggggctgctccacttcaccaaggggtaagcttccccatttcctcccgccctgctttgggataagcatgggggatgaacccgtcccagaccctgcagggcgacattccggtcggcaattggatcgaccgtcatgtccccgccgccgcccggccctatttccgcctgatgcgccttgaccggcccatcggcacgtggctgctgctgttcccctgctggtggagcatcgccctggccggatcgggctggcccgacctctggctgttcgttctgttcgccatcggcgcggtggtgatgcgtggcgccggctgcaccttcaacgattgggccgaccgcgatttcgacggcaaggtggcgcggaccgcgtcgcggcccattccgtccggcgccgtcagtcccacccaggcgctggcctttctcggactgcaattgctcaccggccttgtggtcctgatgcagctcaacaatttcgccatcgcggtgggcatcgcctcgctgctgctggtgtttccctatcccttcatgaagcgcatcacctactggccgcaggcgtggctggggctgaccttcaattggggggcgctgctgggctgggcggcggtcagcggccatatgggtctgccggccttgctgctgtatgccgccggtccgttctggaccctgggctacgacaccatctatgcccaccaggacaaggaggacgacgccctgatcggcgtgaagtccaccgcgctgcgcctgggcgacagtaccgtgacatggctgtggctgttctatcccgccaccctggcgctgatcggcgcggcgggctggagcgcgggactgggctgggcgttctggccgggccttgccctggccggtggccatctgctgtggcagatccgcaaggtggacattcacgatggcgccgattgtctggccaagttcaagtccaaccgccatttcggctggctggtcctggcggccatcgtggcggggaaggtgctatgacccccgtctccgccagttacgaagccgccagtgccttcatccaggccaacaccgaggtggccagcccacccgcctgtcccgagatcaagctgtggaccgccaccgaggtgacgccgctgtgggaggcgacggaagaggcgctgctgcgcgtcaacctgccgccgccctattgggccttctgctgggcgggggggcaggcgctgacccgctgggtgctggaccatcccgagatggtggcgggcaagcgggtgctggattttgccgccggatcgggggtgacggccctggccgtcgccaagctgggcgccgccagggtggaagccgccgagatcgaccccatggcctgctacgccatccgcaccaacgccgaactgaacggcgtcgaggtggaggttctggccgacgacgtggtggggtctgcctgccgctgggatgtggtggtggccggcgacgtctgctacgaggcgcccatgaccgcccatatctggccgtggctggtcaagctggccgccgagggcgccatggtggtgatggccgatcccggccgcgcctacctgcccaagaccgggttgctgcgggtcggtcactatacggtggtcaccagcctggacctggaggacaaggcccagcgcgacgtggggatctacaagatcgttgggtgaggtcgtatcgggctatcgcccgagcccatttggggcgatgccccaaaccccctttgattcataaacgtaagggaggtttggaggtttcctccaaccggggccggggcgggagccccgcatgcctcattcccccacgttgagcagcgcgccccgcacccttgctccatgccaggcccacaggaacagcccggcgccgagcacgaggtagacggcgttgagtgccagggccgaggccagcaggtcgaagcgcatggcgccctcgaacaccacggcgcgcatgccctcgaacacatgggcggggggcagcgcccaggccactggctgcagccattccggcagggtgctgatggggtaatagatgccggccaggggcgccatggcgaagatcagcacccaggccagactctcggcccccaggccgaagcgcagcaccagggccgacaccgccagccccatggcccagccgctgaccatcaggctgaaccagaaggcgagcaggggcaggcccagggtgaagatggaataatggtagagcggaatggccagcaaggcggccggcagcacgccgaccaccgtgcggatcaggctcatggtcagcatggagatgaccagttcgtgcgggcgcagtgggctgaccgacagatgccccagattgcgcgaccacatctcctccaggaaggacagggccacccccagattgccgcggaacatcacgtcccacagcagcaccgcgccgatcaggatgccgcccgcctgggccacccaggtggagtgctcggcgaagaagcggttggtgaagccccacatcaccatgttgacggcgggccagtaggccatctccaggatgcggggccacgagcctttcatgatgtacagatggcgcaggcacacggcctggatgcggcgaagggcgggggaggtcacgacgccgtctccggccgctggcgatcacgggcgatgtcgaggaagacctcctccatggaggcgcggccgaagcgttcgatcagcgcggcgggcgagccctggtcgacgatgcggccctgcttcatcatcagcacatggtcgcacatgcgctcgacctcggtcatgttgtgggacgccagcacgatggtggcgccggcccgctggcggtaggcctggaagtagcttctgacccaatcggcggtgtcggggtccagcgaggcggtgggctcgtccagcagcagcaggtcgggcttgttgagcagcgccttggccagggcgacgcgggtcttctgcccggccgacagcttgcccgccgggcggtcgatgaaatcgcccaattccagctcgtcgcagagttcggcgatgcggtccttgaggcgggccacgccgtagaggccgccatagaccctgaggttctggcgcaccgtcaggcggtggggcaggtccacataggggctggagaaattcatgcgcggcaggacgcggtagcggtgccgcaccatgtcctcgcccagcacggtgatggagccggacgtgggcagcagcaggcccagcagcacggacagcgtggtggtcttgcccgcgccgttgccgcccaggagagcggtggtcgagccggcggcgatggaaaagctgatgccgtccacggccttgaccgggccgaagctcttgaacagcgcttggacctcgatggcgctcaacctcggggacgagcccgcagaccccgcttgcgcgggtcgccctgctgcacgatggactcgatgtggcggccctggaacagggtgatgcccaccgaatggccgtattcgataccggcctggttgtcgcagcggcacagaatgatgcgcgtcacgccgatgcggcgcagcgcctcggtcttcttgtccttttcctcggtcagcgaggggtcccagaccagcttgatcaggtcggcgcccaggcgctcgcggtccacgaagggcaattgcgaataggtcaggccgtcgatgcagatgcgatagccgcggtcatgggcgaagtcgcgggcaaagagatagccgcccaggtcggcgaagatgtccaccttctgcagctccagcacgatggtgccgcgcatgcccgccttgacgttgtcgtcgaacaccaggaattcgggcgacaggatggtggagacgttgaggttgatgctgatatcgccttccagggtgcggtcgtcgtgcttgttcagcatggacagcacccggcggtccagggtctcggtcagctgctggaacagccaggggctggaattgacgttgacgctggggaacagggtctggcgcagatcggcgatggagatgaacagctcgtggaacaccggggtgggcggcgacttgcccaccacggcgcacaccgcctggcggcgcatgaggttggcgaggtcggcctgtcccagcgaggattccacccggtgcagcaattccggggtgaaggggctgcccttggggcgctgcgccaggaccttggcctcctgggccttgcggtccgaggcggcgttgcgcttggcattctcgtcctggaccagcttctgggccagggccagcagcatgtcgtattccttgtccagggaataccatgtgcagaacagggcctgacgggtgcggctttcctcgatcaccagggggtcgtcggagaacaggaagcgcagcttgaccaccgaggcctcgacctcttcctgggcctggaccttgtagatgatcatcaggtcggcattggccatggtgaagacctgggcctgcatcagcttgaccaggttctcgaaggtattgccggcgatgcgggtatggtgctcgcgccgattctgagcctgcagccccgacaggtgcacatgcaccgcccggcggtcgtggcggtggcgctccagccggtggatgtagtccagcagcaggctttcctggctgttggggcggggcatgccgccggagggcggtgcgttcatcatgtccgcatggccttcaggaccgggaacaggtcgagcatgtcattgtcgccgcattcggcgcgcgggcggccgttgatggcgccgtggcgctgggtgcactggttcagcgtacaggccgaggacttctcgcattgggccatggtgacggcggcgatcatggaatcgaggaagcggccctggaacatgcggatgccctgggccaggccccacgacaccgaggtctcggaatcgcagcgcgacaggatgacccggtcgaagcccaccggccccagggcggccagcaactcggcggtcttgatgtcgtcgagcatgtcgttgctccacgccaccttgacgtaatcggtgtcgtacagctcggcatccatgaactgcagggtgaccggggtcataccgtcgaggaccgagcgatgcccgcgcgagcgcaggtagtcccgggtgcggaagaagccgtccaggtcgttgaagatgtccagcaattggaattccaccaccacgccggcgcggccgcggaccgaggcctcgaactgctggaacaccggcgtctgcacggtggccatgttgagattgacggaaaaggcggtgggcatcttgcgaaagcccacgtcctggagcaccgacagcacgcgcaggtccaggacctgggacaggtgctggaacagccagcggttggccaggatgttgacgtcgggggccagggccttctgcaggtccatgatggacatgaagaattcctggaacgccacctcggcatgcatgttctcgttgatgcggatgcaggcctggcggcggaccacgccggcgatgtcggtggcgccgatccgttcgagcactcgggtcaggttcttggcgttcagcggctggacctgcggcgcggtgcgctggtcggctacgcttttcttggcgtcgatcaccatctgcccgcacagcgagaagaaggaatcgtaatcggcttccaggtcgtaatagctgacgaagcgatccccgccctcgggggattcggcataggtcagcggatcggtggagaacagggcgcgcagcttgtagacgatggcgtccaggtcggagaagcgggcatccttgcagatcaggatgatgtccgaattggtcatcaggaacatctggccgcgataggcgtcgaccatggattcgaacatgcggaaggcaatgcggatgcgtccctcctcccggttggccgggagaaggcgcgacaaatgcagatgcagcgccacccggccttcgcggatcctgcccacacgttcggcagcatcgtaaagaaggctttccggcgtgacgacttcctgctgtcttcctccgaacgcgcctgcgttcatcaacaaccccgttatcagcgcaccgatattccgaaaagtcggtcgcaacccccattgtgatcggccatatataaaggcccggttacctgggtgcaaaaaagtatcatcggcgaggccccggccctagtggaaatgatagacgaatctttgccccctctccatcgcgtgcccccgggcatccgcgtctatgctatcggcgacgtccacgggcgtctcgacctgctggaccggctgctggcgcagatcgccggggatgtggacgggattcctgccgagaggatcgtgctggtgtttctgggcgacctgatcgaccggggggcggattcccgcgccgtggtcgagcgggtgatcaagggggcgggcgaaggccccctggccggggtgcgcatcgtctgcctgcgcggcaatcacgaagacaccatgctggaattcctggccgatttctcggtggggccgcgatggttccgcaatggcggtctggaggctatccgctcttatgtgggcgaggtggacgccaagctggcgctggattatccccggctgcagaagatgctctaccgggccatgcccgcccaccacctgcgcttcctgtcctccattcccacctggcaccaggaaggcgactatctgttcgtccatgccggagtcaggccggcggttcccctggagcgtcaggacccctacgacctgatgtggattcgcgagccatttctcggcgccgaccagaggtgggagaagatggtggttcacggccataccgtggtctccgaaccggaagtccggcctcaccgcatcggcatcgacaccggggcctaccggaccggccgtttgacggcgctggtgctggaggaggaccgtcgccgcttcctctttacctgattcggcttgcatggcgggcgccgttgggttagcaggcatcaagccaccaaggacctgcgaatcccatgaccgaactttccgctctcgtcgaacgcgttgaaaagctgcgcggcaccatggttctgtgcgtcggtgacgccatgctggaccgtttcgtctatggctcggtcgagcgcatctcgcccgaggcccccattcccgtactgtgcatcgagcgcgaaaccgccatgctgggcggcgccggcaacgtggtgcgcaatctggtggcggtgggcgccgagccggccttcgtgtcggtggtgggcgacgatacggcgggccgcgaggtcacccggctggtgggcgagcacggcgagatcgatccctgcatcgtggtcgagccggggcgccagaccaccatcaagacccgcttcttcgcctcgcaccagcaattgctccgcgccgaccgcgagtcgcgcagcccggtcggcgaggccatccgcgcccagttgctgacccggatcgagcggctgttgcccaaggccggggtgatggtgctgtccgattacggcaagggcgtgctggccgagcccatcgccatcgaactgatccgccgggccaaggcggcgggcaagcaggtcatcgtcgatcccaaggggaccgattacaccatttatgccggggcgaccgtggtgacgcccaaccgcaaggaactgcacgaggccactggccaggcggtggacagcgacgagcaggtggtcgccgccgcgcgccagctgatcgacagctgcggcttcgaggcggtgctggttacccgcagccaggacggcatgaccctggtccgcgccgacggccagatcgatcatctgcccgccgaggcccgcgaggtgttcgacgtgtcgggcgccggcgataccgtggtggccaccctggcggcggccctggcctcgggcgccaccctacccgaggcggcccatctggccaacgtggccgccggcatcgtggtcggcaaggtgggtaccgccgtggcctatggcgacgagctggtggtggcgctccaccgcgaggacctgaccctgggcgaggccaagatcgtgccggtgacagcggcggccgaggtggtcgaccgctggcggcgcaagggccagaaggtgggcttcaccaatggctgcttcgacctgctgcatcccggccacgtctccatcctggcccaggccaagggagcctgcgacaagctggtggtggggctgaattccgatgcctcggtccagcgcctgaaaggcccgacccggccggtgcagtccgaggcgtcccgcgccaccgtgctgtcctccctggccaccgtcgatctggtggtgatcttcggcgaggatacgccgctggaggtgatcgggaccctgaagcccgatgtgctggtgaagggcgccgactacaccatcgacaaggtggtgggcgccgatctggtccagtcctggggcggcaaggtggtgctggccgaactggtcaacggtcaaagcaccaccaacaccatcaagaagatgaacggtaactgagatgggaaccggcacggagcatctcacccagctcggccagtccaccgccctgcccgccagtcccgacaaggcggtgctggagacggtgccgaaccctcatccggggacgttgtatctggtgcgcttcacggcgccggaattcacctcgctgtgcccgatcacggggcagcccgatttcgcccagttggtcatcgactacgcgccggaaggctcgctggtggaaagcaagtcgctgaagctgttcctgggatctttccgcaaccacggcgcctttcacgaggattgcaccatcgccatcgccaagcggctggtggcggcctgcgcgcccaaatggctgcgcatcggcggctactggtatccgcgtggcggcattcccatcgacgtgttctggcagaccggcccggcccccgaggggctgtggctgcccgaccagggcgtggccggctatcgcggccggggatgagcggggcggacgccaagtccctgatccgcgacgatgacgtcaaggcggcgattcgccgccgggcccttgatctgggcttttccgatgtgggcttcgcccgtgcccagggcctgccggagtggaaggccgacctggacgcctatctggccgacgggcgccacggcaccatgggctggatggccgaaaccgccgaccggcgcgccgacccccaggttctgtggccggacgcgaaaagcgtcatcgtgctgggcaccaattacgccccgtccggcgatccgctgaagctcacccacttgcccgagcggggcaatatcagcgtctacgcccgcaaccgcgactatcacgacctgctcaaacggcgcctcaaggccctgggccgctggatggccgagacctgggggggcgagttgaaggtcttcgtcgacaccgccccggtgatggaaaagcccctggcggcccagggcgggctgggctggcgcgggcggcacaccaatatcgtgtcgcggcgcttcgggtcgtggctgttcctggcggaggtcttcaccaccctggagatcgagcccgacgcgcccgaggccgatcattgcggttcgtgtcgggcctgtgtcgaggcctgccccacccgggcactggacggcgaggggcggatcgacccgcggcgctgcatctcgtacctcaccatcgagagcaagagccctatccccgaggatttgcggccgggcctgggcaaccgcctgtatggctgcgacgattgcatggccgcctgcccctggaacaagttcgcgccgccgaccaccgagcccgatttcctgccacgggtcgagctgaccgcgccaaggctggccgatctggtgcaactggatgaagcgggattccgcgaagtgttcaccgcttcgccggtgaagcgggcgggctatgagcggttgatggccggggtgctgatcgccgccgccaatggcgggcagacggatcttctggccgaggcggaacggcgacgggatgatccgtcgccgctgatccaagacgccgcccgatgggccgtctcagtcctcggcggccagggcccgggcgagctgtgacagggcttcctggtggcgctcgttggtgatggaggtgaagttgcgggccagctccaggcacatgcgctggcgggcggacaggtcgctgccccggcggttctccaggccttcatagaagaagcccaccggaacgcccagcacctgggcgatctcgaacagccgtcccgccgagatgcggttgatgccgcgctcgtacttatgggcctgctggtaggtgacgccgatcaggtcggccatctgctgctgggatagcccgagcatgatgcgtcgctcgcggatgcggcttcccacatgtctgtcggtatcgttggcccggttcatggggcgggcaggttttgcctcggcgcgtgtcggcatgatgttcagttggtctctgacttgaccgctctgaagttgcggctgcttttctgtatcaggcatggctacctttccccgtgcatagtcggaattggttaggcaagcaacccgaaactggaagtatatcggaaacccgcaatcagtatttaccggtgtgagtacaggtttttactttactgtgtatatgtcttgcggtgtcgcgcaaccggggcgttccatcgcccgatccggacaccatccggaaccgtttccgacgagaccatctcggaaagtacatatggagatggtctcggtcgctcaccagaccgaaacaatcagctagttcgaatggagtaagtgttgccgcctagacggacaggtcgacgccgcgtccggaggccgccgacgggttcggcgacaggacctcgtattccgtgtcgcgggacttgccggacagggccgaggcgcggttggcggcgtcggcataggcggtgttgccataggcggcgctgccggccaccgaggaccgggtggtctccgaggcggtgccgctctgttcctgggccagggcctgggtcaggaaggcggaggacgggcggggggtgttgtcctgggtgctctgctggcggtcggcgacctgggattgccgccgctggtcggacttggcctgggccgcctgctgctgcgccgaggattgctcctcgacctcggcattgacgcggggatcgggctggttgctgactgcctgggtcgccgccacggctccggcacgcgccgccctgatcgcgtcgatcagattcgccgtgctgcccgaaccggtgatggcgccaatggacaagtcttccgctccgcccaagagttaagaaaatgataatagcctcggccgcggcggaaatgcaatcaggtggaatcccggtatcttcaccgcaattcccagagcggcccgtatctgcgatgatcgtcgcccaggccacgccccggcggcgtagcgcaaccggaaccatgggggggtgcatgagcgacggatccgaaggaacggcgacgctgcccgccaacaaccgtgcggccttgcggcaggtggtgcgggcggcccgcaaggcggcgctggccaccagtctggccggcggccgggataatcacccctatgtctcgctggtcaccctggccttcgaccacgatctttctcccattctgctgctgtcgcggctggccgaccatacccgcaacctgctggccgacgggcgggcggcgctgctgctggacggcaccgacggtctcgccaatccccagaccgggccgcgggtcaccttgacgggccgggtcgccgaggacggcgatccccgcctgcgccgccgctttctggcgcgccacccgggcgctgagctttatgccggcttcggcgacttcgccatctggcgcatgaccgtggagcgggcccatttcgtcggcggcttcggtcgggcggtgtggttcgacgcgccgctggtccccgaggacgaggcggccttcgtggccgccgccgaggagggcgccctggtcgagatcaatgatgcccatgccgccctggtggccgccctggctgcgcaggccggcggcgatggagccatggcctggcggctggccggaatcgatcccgacggttgcgagctgggcgcgggcgaggcggtgctgcgcctggccttcgattcggcgcccgacagatcgtgttcgccgctttcctggctgcaaagccttgtggcaagccaatcaaagtgatgcgtcttttgcggccagttggatcgctttttgagcaataatcttaaaaatgggtgaatttttcccaccaagagcattgctcgcggggcctcgggcggctatcttcgcgtcctctttcgcggcggcggcgcaaaccataaaagggcgccagaccggcggccggtccaaggaaggcctgtccgttcaggggtatcgtccccggggcggcgggaggatcgggtcctccggtctttaacggagtaggatggaaatgaccaagagcggtattcctggcgggaccaccatgaacgccaaattgctggcgtgggtcgacgagatggcgcatttgtgccgcccgtcgggcatccatatctgcgacggctcccagaaggaatacgatgccctgtgcgagatgatggtggccggtggcaccatgatcaagctgaacccggccaagcgccccggttcgtatctctgccgctcggacccccgcgacgtggcgcgcgtcgaggaccgcaccttcatctgctcgcacaacaagaacgacgccggccccaccaacaactgggtcgagccgcgcgagatgaaggcccgcatgaccaagctgtacgacggctgcatgaagggccgcaccatgtacgtggtgccgttctccatgggtccgctgggctcggacatcgcccatatcggcgtgcagatcaccgattccgcctatgccgccgccaacatgcgcatcatgacccgcatgggccagccggtgctcgacatcctgggcaccgacggtgatttcgtgcagtgcctgcactcggtgggcaagcccctggccgagggcgagaaggacgtcgcctggccctgcaatcccgacaacatcaccatcgcccacttccccgaggaccggcagatctggtcgttcggctcgggctacggcggcaacgctctgctgggcaagaagtgcttcgcgctgcgcatcgcctcggccatggcccgcgacgagggctggctggccgagcacatgctgatcgtcggcgtggaaagccccaagggcgagaagacctatgtggccgccgccttcccgtcggcctgcggcaagaccaacttcgccatgctggttccgcccaagggcttcgacggctggaagatctacaccgtcggcgacgacatcgcctggatcaagcccggccccgatggccgcttctatgccatcaatccggaagccggcttcttcggcgtggctcccggcaccggcgccaccaccaatcccagcgccatcgccgcctgtgccaagaactccatcttcaccaatgtcgccatgaccgatgacggcgacgtgtggtgggaaggtctgaccgacgaggctcccgcccatctgatcgattggaagggcaacgactggacgcctgagtccaaggacccggccgcccatcccaattcccgcttcaccgcgccggtcgcccagtgccccagcgtcgaccccgattgggaaaatccggcgggcgtgcccatctcggccttcatcgtcggcggccgtctgtccaagaacgcccccctggtggtccagagcttcaactgggctcacggcgtctatctcggcgccaccatgggctcggaggcgaccgccgccgccgtcggccaggccgccatccgccgcgatcccttcgccatgctgccgttctgcggctacaacatggccgattacttcaaccattggctcaacatgggccgcgccgtgaagaacccgccgccgatcttccgggtgaactggttccgccgcgacgagaacaacaagttcatgtggccgggctatggccagaacatgcgtgttctgaagtggatcgtcgaccgcgtcggcggcaaggccaaggcggtggaatcgcccatcggcctggtgccccagtacgaggacatggactggaacggcctcgactatccgcgcgacaagttcaaggacctgatgcgcatcgaccgcgacgccggcgtcgccgacgcccgcagccaggaagagctgttcgacaagttcttcgaccgcgtgccgaaggaaatgctgttcgagcgtgaactgctgaagtctcgcctgtggcgcgctcccgccgtgtgggagatggccagcgagaagatctgaacggtctttccgttacaagtttgaagatccccgcccggcaacgggcggggtttttcatgaccaagtatctttaaattcgtccctcgccggtcgcctgccgccctattccgccgccttgtcgcccaggggcttggcggggtagggggagacggcctggccgacattgcgcatctgcggctggtcgccggccgaccaggaatggaagcgcagcgtgccgtcggggctgaacatcaggccggcttcgttgcttttgacgttccagccgccccagacctgggacgccatcggcacgaaattgaccgcccgggtgtgcgacgtctgggccacatagaccagcatgcgcgagccgtcgggcagggtttcatcgcgatcgggcgttcccagcagggtgaaggcttcggccaccgtcgacttgccgctacgcagttgggccagtttgtcgggatcgacgcccgaacatcccgccaccgtcaccgccattgcaaccgccagccaaattcgcatggaaccgctccccgtctgatgcgggcgtatcatggcccaagctggcgagccgggcaatcgcgggaaggggacaatacttcgtcggtcttgactcgcgacgggcggcgacccaagcatgatggctctgcctgttccggtttggggtatcccgtcatgaagctgcgttattccaccacctcgccctatgcccgcaagtgctgggtggtcgccgtcgagaccgggctggagccccgtctcgaattcgtgctgaccaatgcctggtcgcccgacaccgatctgacccgggacaatcccctttgcaaggtgcccgccctgatcaccgaaggcggcgaggcgctgttcgattcccccgtcatctgcgagtacctggactcgcttcatgacggccagaagctgttccccgccgccggcggggcgcgctgggagcaactgcgtctggccgccctggccgacggcattctggacgcggcgctggtcaagcggctggaggccaccatgcggcccgaggacaagcgctggagcgactggaccgaccgccagacccgggccatcgtccgggcgctggacgtgatggaagaggaatgcgccggctgggggcgcgacttcctgatcggccagatcggcgcggcggtggcgctgggctatctcgactatcgcttcgccgccgaggactggcgcgccgcccatcccaagctggccgcctggttcgccgaggcgatcaagcgcccctccatggtcaagtccgagcccagggactgatcatgccggatgcggaggccatcatcgcccggctgggcctgcagccccatcccgaaggggggcattacgccgagacctggcgccatgtccccgagggggggggacggggggcgggcaccgccatctactatctgctgaaggcgggcgagcggtcccactggcaccgggtcgacgccaccgagatatggcactaccatgccggcgatccgttgcgcctgctgctgtccgaggatgggcgcggcgtgcgcggcgtgctgctgggcccggatgtcctggccggacacatgccccaggtgatcgtgccgccgggctgctggcaggccgccgagccgaccggggcctggaccctggtgggatgcaccgtgtcgccagccttcgagttcggcggctttgaaatggcccccaagggatggagcccgggacaatgaccttacgcgtgcttgccgtcgccttttccctgtcgctgctggccgcctgcgccggatcggacagcgtcagcaaccggctgccgccgggcttcgtctccaatgccgccgagatcgtcgccggcgctgattgggccgcgccggaggaggtgcggatcaccatcgccgaccacgccttccggccggcggagtgggtctttcaccgcgaccgggccacccggctggtgctggtcaatgccaccgagtccgatcacggcctcaaggcccgcgccttctttaccgatatcgcggtggaaagcgtgcgcggcggcgggcaggtcctcaaggggccgtggatcgagagcctggccattcctgcgggcgaaaccaaggaattgtggttcgtgccggccagattcggctcatactcattcgagtgttccgccgtcggccacccgtccctgggcgagcgcggcgtcatcgacgtggtgcgctgacatgatgaatcaggttgccgctctgatcttcgacgtggacggcaccttggccgagaccgaggaggcgcatcgctatgccttcaaccgggccttttccgaggccggtctcaattggacctggaaccaggaaacctaccggaagctgttgaaggtgtcgggcggcaaggaacggattctggccttcgcccccgatgcctcgcccgagctggtggctgggctgcacaaccgcaagaaccagatctacaccaagatggtggatagcgggcaggtgtcgtttcgccccggcgtggaatcgctgatctcctcggcgcgggcccaggggctgaagctggcggtggccaccaccgcaacgcgggccaatgtggaaaccctgctgggggcgcgcaaggccttctttcacaccatcgcctgcgccgaggacgtgcgcaggaagaagcccgacccggaggtctacgccctggtgctcaagcgcctggacctgccagccgacaaatgcctggtgctggaggattctgtcaacggcgtgacggcggccaccaccatcggcctcaaggtggtggtgacccccagcctttataccaaggggcaggatttctcggccgccgcggcggtgctcaaggatctgagcgggatcaccctggccaagctgattgagctcaagggctgagacgggtgcagcacgtcatcacgatcttcaaagattcttcacggttacgctgataggctcccggtcgtcgaccccggtcttcttcatcacggaaattccatggctcaacttgatgtactgatcgtgacgcctccgtcccgcctggaggtctatcagaatttgagcaatgacttcgcggccatcgagccccccgtctggggcgggctgatcgccgagtttttgcggagtcgcggagtcgcggtggccatgctcgatgccgaggccctgaagctgacccacgagcagaccgccgagcgcatcgttgccgcccagccgctggtcacgctgatcaccatttacggccagcagccctcggcttcgacccaatgcatgcccgccgccaccaagaccgcccgcctggtcgccgagaagggcaagggccggttggcgaccatcgcactgggcacccatccctcggccctgcccaagcggaccctggaggaagagcccttcacctatgtctgccagggcgaggggccttacaccctgctggagctggtccgggcattgaagagcgacggcgacctcggcgccgtccccggcctgtggtaccgcgaccgtgacggcaaggtgcgctctaacaccccggcgccgctgatcagcgacctggacgcggagctgccgcgtcaggcgctggacctgctggacatgagtctttaccgcgcccacaactggcattgcttcggcaatctggacagccgggattcctacgcctcgctgcagaccagcctgggctgcccgttcaagtgctcgttctgctgcatcaacgcccccttcggcgtgaacaagatccgcacctggagcccggacaacgtcatcgcccagatcgacgagatggtgctgaaatacggcgtcaggaacatcaagattcccgacgagatgttcgtgctgaaccccaagcacgtgctgggtatctgcgacaagctgatcgagcgcggctacggcctcaacctctgggcctatgcccgcgtcgacaccctgaatgacgatgccatgctcgacaagctgaaggcggccggcatcaactggctgggcctgggcatcgaatcgggctccaagtacgtgcgcgacggggtgaccaaggggcgcttcggcaatctcgacatttccgccgtagtccgccgggtccgcgacaagggcatttacgtgggggcgaattatatcttcggcctgcccgacgataccctggaaagcatgcaggaaaccctggatctggccatcagcctcaataccgagtgggccaatttctactgcgccatggcctatccggggtcgcatctctacgagatggccaaggagcagaatctgccgttgcccgatgatgccggggggccgggctggatcggctatgcgcagcacagcttcgactgcctgccgttgcccaccgccacgctgtcggcccagcaggtcctggatttccgggatcaggcgttcacccgctatttcaccaatccggattatctcgagatgatccgcaagacattcggcgagcgggccatggcccatgtccgggacatgaccggccacacgctgccccgccgccatcgccagaactaaggtcagactgcattccagtggaggtaccatgaaggtcggtgattacgtcatcaatcggctcgccgaagagggcatcgacaagattttcgtcgtctacggcgcggccaacggcgatctgatcgacgcgttcacgcggacgaacaagaccgagtatgtggcgaccatgcacgagcagggcggcggcttcgcggccgaggcctatgccaagatcaagggtatccccggcgccaccatcgccaccagcggtcccggcgggcagaacctgctcacctccatgggcaattgcttctacgattcgatcccctgcgtcttcatgaccggccagatcaattcccagttcctgcgccccgacccttccatccgccaggtgggcttccaagagaccgacatcgtcggcatggccaagccggtgaccaaatacgccaagatgatcacctcggcggcggaaatccgctacgaggtggaaaaggccctgttcatcgccaaggaaggccgtccgggtccggtcctgctggatattccgctcaacatccaaaagcaggacatcgatccggacaagctgttcggcttcgacaccgtggccgcccagcggtcgtggaacctggacgcggtggacgcggccatcgacacctatctggccgatctggccaagtccaagcgcccgaccatcatggtgggcggcggcgtccgcctcgccaatgccgtcgacgatctggtggagctgggcgaggtgctgggcgttcccatgttcccgacctggaacgcgctggacgtggtgacctcggacctgccccagtacggcggccgcatcggcacctatggcggagccgggcgtaatttcggcatccagaattccgatctgctgctggcggtgggctcgcgcatttcggggcgcatcaccggcggcaacatccattccttcgcccgcgaggccaagaaatacgtggtcgacgtggacgagaccctgctgcagaagcatctccagcaggttcccctcgacgtcaatgtgctgtgcgacgccggaatcttcctgcgccgtctggtggcccgggccaaggctctgcgcgccaatggcgggttgggcgaccacaaggcctggctgtccaaggtgctggactggcgcgaccgctacgatcccgtgctgcccgaattctttgagcagaagggcacggtccacccctatgccttcgtccgcaagctgtcggagatgatgaagggcggcgatatcgtggtcggcgattgcggcggcaatatcgtggtgaccagtcatgccttcgagaccaagcgcggtcagcgcctgctcaccaacaacggcaattcgcccatgggcttttcgttcgccggcgccatgggcgcctggttcgccgcgcccaataatcaggtcgtctgcatcattggcgacggcggcatgaacatgaacatccaggaactgcagaccttcgtgaattacggggtcaaggtgaagacgttcatcctcaacaaccacatctacggcatcaccaaggcctatcaggaaaccaacttcaacggccgggccgaggcctgcggtcccaagggctatgcgccgccggacttcgtcaagatcgcccaggcctacggggtcaagacggtgaccatcgagacccagcaggagatggaagccaagatcgccgaggttctggccgccgattgcgccgtggtctgcgacgtcaacatgcacgagtaccacacctacgagccgcgtatcttcggctggaagactcccatcgaggacatgtacccctacctgcctcgcgacgagttccgcgccaacatgctgatcgagcccctggacgattggcagaatcccgcctatcccgacgtcgttcagaagaagactctggacccctgagcaggttggcgccgctctgaccggcggcgcctcttgccattacctgtccctggatcggccgaggaaaatccatgttctatgaacttgccagccccacctggggggaagaggaaaacgcggccgccgagcaggtcatccgcagcggcttctacaccatgggcgcccaggtgaaggcctttgaggccgagtttgccgcctatatgggcatgcgccacggcatcatggtcaattcgggctcgtcggccaatctggtggcggtggcctccttgttcttcaaggccgaccgccccctccagcgcggcgacgaggtcatcgtcccggccatttcctgggccaccacttaccatccgctgcagcaatacgggctgaagctgcgctttgtcgatgtggagctggacagcctcaacatggatgtgtcgcagttggatgcggcgctgaccgacaggacgcgggccatcgtcggcgtctcgattctgggcaacccggcggccatggacgtgattcgcgcctttgccgacaagcattcactctacgtgctggaagacaattgcgaatccctggatgcagagctgaacgggcgcaagctgggcaccttcgggcatctcaacaccttcagcttcttcttctcgcaccatatctccaccatggaaggcggcatggtgctgaccgacgacgatgaactggcggatctgtgccgggccatgcgcgcccatggctggacccgtgatctgtcgcccgacacaacactgtattccaagcggtccaacgaccattacgaggcctatcgcttcctgttcccaggctacaatgtccggcccctggaaatcgaggcggcggtggggcgcgagcagttgaagaagctgccggccttcacggcgcggcggcgcgagaatctcgccctgttccagcggctgttcggcaacgacgaccgcttcatcatccagcgcgagaatggccgctcctcggctttctcgttcaccctgatcctcaatcccaagctggacatcgaccgggaaaaggtcttcgcggccctcaaagaggccgatatcggcttccgcattatcaccggcggctgcttcctgcgccacgactgcctcaagttctatgattatgatgtggtcggcggcggggtgcccaatgccgagacagcccatgatttcgggctcttcgtcgggaaccacccggtggatctgaccgcccagatcacccgcttccacgaggttctcgaccgtaactgccggtgatggggatgggagccccgcggggctctcgccccggaccccagttggaggcaagcctccaaacctcccttctatttatgaatcaaaagggggtttggggcatcgccccaaatgggtgcgggcgatagcccgatgctacgccgccgccctcaaagggattccgccagggccaccactcggcggacgccctcgtggacgtcgagggccgcgccgcaggtggcgatgcggatgtggccggtcatgtcgggcgagaagctgctgcccggcgtcacggcggtctggtggcgttccagcagcatgctggagaagctgaggtcgtccaggccgcaggccgaaatgtcgaggaagaagtagaaccccgccttgggcggcacgaaggccaggcgctggctctttcgcaaggcctcagagcaccagtcggtcatcacggtgcagtggtgccgcacctcctcggtatacttgtccagatggtccagtgccgcgacgcagcccaactgggtgaagatgggcaggcaggaaatcagcgtcgacacagacagggcgaatttctcggccaccttggggtgggcgatgagaaaaccgatgcggtagcccggtaccgagaacagctttgagaacgacgacatcaccaccagccggggcagttccagcccgcccagcgtatggaacggccgtccgaagctgatctcgccataggtttcatctgacagcagccagataccgcgccggtcgcactccaccgccaagcgctccaactgggcgcggtcgtagacggctcccgtggggttattggcggaattgacaatgatcgccttgggggccagggccagggcgcggtccacggcgtcatcgctgaggtcgtagccggtggcgaggtccagcggcacgctctcaaccttgaggccgatgtggatggccgccgcccaatagctggggaaggcgggggtgaagaataccacccggtcacctggatcgcagaccagatcaagaaactggctgatgatcaggttggccgggctgatcaccacattggcttcggtaacggtatggccccaggtgcgcgcgcgcaggtcggcgatggcctggcgcagagaggggtgcccggcggactgggtatagcccacctcgcgctcgaccagggcctggacggtgcgcgacagcatggctggatggggggcaaggcggggattgcccagttccagatggtagaccttctctccggcggtctcgatccggcgggcttgttccaggacggcgaacattttttggccgaccagcgctctgcctcgcgccgagaatttcaggtcttccgtcatgggtattctgcccttgtctcggcggctcgatcactgcccccgaatctgccgttgaaagcttaagatactatttccagaaccagaggcccccgtcacttcctgatggcgatgacttccatgcagacgcggtagcgctcgctgacggcgaagttcaccggcgtgaaaccatggtcctccagcagggcgtaaagccgttcccggctgaaattgtgataatgctcgatctcgggccaatagggattgagcatctgctggtcgagcaggcgccagaccatgctggacatgttgggcatggacacgaagatcgccccgtcgggccgcagcagggaacgggccttgtccagggcggtgcggggatagggcatatgctccagcacatcggccatgctgatcacggcaaatcgtcccggcatgtcgagctgttccaggggctggcaataggcctcgtagcccagcgccgccagggcggcgacgccgtcgctgcgcaagtcggttcccaccgggccaaagccgaactcctgggcggtgaacagcagcgagccgttgccgaagcccacatccagccagtcaccgcccgacacatggcgggcgacgcgctcgacgatgcgggccgagacccgccgctgcccttcggcatcgtgcccgaccgcctgactttcattggtcttggagaagatcacccgggcggcggcctcggtgaaatagccgtcggtgaagacgtgggcgcaggcattgcaccggcaccagaccatctgggcgggcaggatgtcctgatacaggggatggtgggtgcagtcggcatagccgagcgctgcgaaatctccactggcgcagagagggcacgcggtataggggatacgggcggaaaccggcgtcggggcgggggcgttgtccacggtcttccttaacacggttgcgggcacgtctgatgggccgggaatactatcatccgccacggaggtgggcgacgggtttctcctccagatcggccgggcggctggtgtaaccgcttgttaagtcccaggagataaggtctccgtcagggcctcgcggggatttttacgacggggcggggagggggaaaggccaatgaccaccatcaagaagaccccgtttccgctgaggctgcccgagaaccggctgcaggccattcacccctcgctggacgcggcgttcgaggcccacgactatctctatgttgcccgctatggcgaggatcggcccgagctgcgcggctgttcgctgatcctgctgggcaaccgggtcggcggcgaattggtgctggaccggcacaatgttcacacggcccgatcgtgcctgtaccgcgccttcggtgcctggcgcgacgacgatctgggcgaggccgagcgccagatcgccgaggggctcaagctgaagggcgaggccaagcgactcaagcggctgcaggacctcatcgcccgccagacctgccgcgtggtgatccataccgatttcggccgccccgaccggctgcgcggcttttatcagatacctggcatcgacctgatcatcagttcgcacatgctgggcgatcccgccaccaccctgcccatggggcaatccctggccagcatggtcccgcccggccccccggttgatctggtgctggtcgacgacttcaagatggtgcctgtgggcttgcgcgacctgggcgctccggtggtggtcaatccccacgatcacgaatggtattacgagatcctcgacgagctgatgcccgaggtcgatctggtggtgaacctgagctcctgggaagaggtcgagctcaatcgggcgttcggcgtgccgggcaccagtttctactacatcatgtccctgctgattccccagatcagcgggttgaaggaggtctacgaagacccccggcggcggcaactggatctggtctttaccggcggcatcacccacgacttctatcgtgacaagcgccagcggatcgccccactggcgcggctcgatcccgcctttcaggtccgggtgatcgaggggtatctcaatcacgatgagttttatggcctgctgcgcgagacccgcttcaccattcacagcgcacgcaccaccaattccatgaccacccggtccttcgaatccctggccaccggcaccttccaactggtggaggaggagaacggcgttccctatatcttcagccagaaattcgagtgctttcccgtcttccgcctatcccacgtggtcgaggatatcgagcgccatctggccgattacgaagggatgcgcgaacggttcctgcctcaggcggcgcagttggaaaaggaactgaacgatctgatgcctgacgacgaggggcgccgcgccctgcgctttgtccgccagttgatgttcatgacccaggtggagatggaaggccgcaagaaggcggatgcacccctggccgcgccggtccagcgcgactgggtcggcatcaccgagccctggcatctgagcaaccggcccgatcagtcccagcgggtgttcgagcgcacgcgctcgccgcactgggtgcgccgtgcggtgatgtcgacggccacccggacggacggctgggggcagcggctgcacgaggccatcctgcagggcctggccgaatttcccaattccctggggctgaactataccctggcgctttatctgcggctggtggggcatcccgaccgggctgatgagctgttcaagcgcatttccgagggtgagttcgtccttgaacccaatgagacttttcccgggcagatggacaacgtcaacggcctctactgggtggccgacgccaagatccgcgaccgctgcccggccctggcaccctatgtttccgaggatgccgtctggcgcagctacgccctgaaccagcgggccgacatggcgatcacccgcgcctcgagcctcggtggcaacgacgccgtggcggaatattctcgcgccttggccttgctcgagacctcgctggaccgcttccccgccaatgaaagcgcccagcgcctctacctgcgcgccgccttcggcatgtgcgtcaacggcctggacgaatggcgcgacgtgttcatggccaacttcgacgtggcggtggagaacgattatacggtattgcacgatttcgcccccctggctgtccaggtgctgatgagccgccacaaggtggccgaggcgcagcaggtgatcgaccgggttgggcaatatctggcgcgaacggtgatcacgccgtcactttgcccagaagccgtccactgggcgcgtatctttggtttgccgctgcgtggtctggatgcggcgcgagccgcctagaccgatttcatcaatctttggaaagacgaggatcttgccatgtacaacattctggtgaccggcggcgccggctatctcgggtcgatcatggtgccggccctgctggccgccggccacaaggtcacggtggtggacaacttcatgttcaagcaggtgtccctggcccattgctgctcggaccccaatttcagcgtcgtccggggcgacgtgcgcgacatggcgctgatgaagcgcctgctggtgggtgccgacgtggtcatccccctggccgccctggtgggggcgccgctgtgcaaggccgacccctttggtgccgaaagcatcaacctgaccgctcagatcgagctgatgaaggcgctgtcgcccaaccagcgggtcctgatgcccatcaccaattccggctacggcatcggtgaaagcggcaagttctgtaccgaggaaacgcccatgcggcccatttcgctgtatggcatccacaaggtcgaggtggaaaaggcggtactggaccacagcaattccatcagcttccgtctggccacggtgttcggcatggcgccccggccgcgcctcgacctgctggtcaacgacttcgtctaccgcgccgtctacgaccgtttcgtggtgctgttcgaaagccacttcaagcgcaactttatccatgtgcgcgacgtgacgggcgccttcatgcacgggctgaccaatttcgagaccatgaagaaccggccctacaatgtgggcctgtcctccgccaatctgtccaagtgggaattgtgcgaagtcatcaagaagcacctgcctgacttcgtcttcgtggacgcgcccatgggcgaggatccggacaagcgggactacatcgtttccaacgagcgtctcgaggccaccggctgggcgccgcaatacgacctggacaagggtgtcgtcgacctgatcaagggctataccatgctgaagaacaccatctacaccaacatctgagccggccgtcatgagctccggcgcgggattggacggcatcgacgttgtggttctggccggcgggctgggcacccgcttgcgcggcgtgctgggcgaccagcggcccaagatcctggctcccgtccagggccgccctttcctcgacctgatggtggagtggatggcggcggcgggggcggggcggctggtcctgtcgctgggccatctggcccagcaggtgaccgtccatctcgaccggggccgctggcccatccccatcgtgacggagatcgagcccgagcccctgggcaccggcggtgcgctacgctacgtgctgccccgcctgcacggcgatccggtgatgatcatcaatggcgatacctggctggacgccgatctgggcgccgccctggcggcccaccgccgggccggctgcgcggccagtctggtctgcgtgcgggtgcccgacgggcagcgttacgggcggatcgaggtggatgccgggggatttgtcacccgcttcctggaaaaggctcccgatcccaccccggccctgatcaacgccggggtgtgcctgttgtcggcgcccgctctggcccggctgggacagagcacggggccgtccttcgaacgtgacgtcctggccgaactgccgcgcggctggctgcgggcgcatgtgtgcgaaagtgcccgcttcatcgatatcggcacccccgaaagcctggatcaggccgcggacgtcatcacaccgggtagaacgtcatgatcaccggcgccagtcttgacatgcgggacgatggaaacggtcgggagccgcattaagccttcgaattggccagataccactcatagccgcgccggatgctctcctccagcgatgtggcggcctgccagcccatggcgcggatgcgggtggaatccaccagcttgcgcatcatgccgtcgggtttggtggtgtcgaaggacagcttgcccttgaaccccaccacgcgggcggtgagttcggccaactcgcggatagaggcttcgatgcccgagcccacattgatgatctcgccgccgcccagggacttcatcaggaagacgcaggcgtcggccagatcgtccacgtagaggaattcgcggatcgggcttcccgttccccacaattccaccgtatcggcgccacgctggacggcgtcgtggaacttcatgaccagggcggcgcccacatggccgttctcggcgtcgaagcggtcgcccggcccgatcaggctggccggcaccgccgacatgaagtggcggccatactggcggtgataggcctcgcacagcttgatgccggcgatcttggcgatggcataggcctcgttggtgggctccagcggaccggtcagcatggaggactcggccatgggctgggcggcctcccggggataggcgcaggacgagcccaggaacagcagccgcgacacccccacccggtgggccgcatggatgacattcatctcgacggcgagattgtcatagaggaactcggccgggcgggtggaattggcgcggatgccgcctaccagggcggcggccaggaacacggcgtcgggccgtttgtcctccatccacgcctcgacggcagactggttgcgaagatcgagcgccaagcggtcgacggtgagagtctcgcaatcctcggattgcaggcggcggaggatggcgctgcccgccatgccgcgatgacccgccacgaacacccgcttgcccgccaaagaaaaattcgccccggccattgtgtcctcaccctattgcctgactggcgccgatcataggccggaccccgggagctgtcatcaggcctcggtggccttgatccgccgggagagggtggccatggccagggcgcccgccgccaccagtccggcctccagccccaatgtcccggcgacgcccagcccggcggccatggcgcccgccgccagcccgcccagggcatccatgccgaagcgcagcgccgtgaagtaggaaatcacccggccgcgaatggcgtcgggcgccatggattgcagcagggcgttggtggagacgttgaccgagctgatccccagcccgatgcagaacgccgccgccagggcgggcgtcaggctgggactgaggcccaatccgcccagccccagcgccgcgcagccccagcccatgatcaccagccgcaaaagctgctccaggcgctggcgggtggccaccagcagggtggcggccagcgccccgccgccggtggcgcccagcagccagcccagggtgctggcatcgccggcgaacccctccttggccaggatgggcatcagcaccccataggccgagcccgccagattgagtgccgccacactgaacaacagcgtccggatggtctggttgttccaggcgaaggccagcccctggcgaaaggcctcggccattccccccgaggccccggagggcggctggggcggctggcgccagacggcgaaggccacgcccaggaacgaggcggcattgatggcgaagcaccagctttccgaggtgaaggacaagatcagcccggccagcggcgggccgacgaagcgcgccgaattgaacagcgaggcgttcagcgcaatggcgttgcgcagcagggcgcggtcctcgaccatgccccccagcatggattggcgcagcggcgtgtcgacgctgttgagcacgccgaacagcgccgccagccccaccagatgggccggcgtcaccacccccagggcggtgatggccgccagcagggccgcctgggcgatcatcagcgcctggacgcacaggaacaggcggcggcggtcgaagcggtcgatgaacaacccggccaggggcgagatcaccaactgcggcgcctgggacagaaaggcggtgacgcccagcagcaccgccgagccggtcaggcgatagaccagccagctcatggcgacgctctgcacccaggttcccaggatggacagcgcctgacccgcgaagaagcggcggaagcggggggctccgagggcggcgaaggccttatgccggggagcgtttaatctgacctttcctgtcatcccgagcgaagccgagggatctccgcttggagcaggggcgccaattccgaaacgtcgtgccaggatgagatccctcctcccgttggtcgtcgggatgacatgtcgcttgaagccttaatagccggcacgatccgtctgggcgggcggcgccacgtccttgtaggtggcggccagggccgacagggcgcggctcagcaccatggtgtcgatgcccaccgccacgaaggtcgcccccgccgccagaaatttgcgggccagggtctcgtcggcggccaggatgccgctgggcacgcccagacgcttcagcatcgccagggccttctcgatctcggcctgcacctcggggtgggatggtgcccccagatgccccagcgaggcggccagatcggcgggaccgatgaagatgccgtcgacgccgtcggtggtggcgatggcctccaggttgcgcagtcccgtgaccgtctcgatctgcagcagcaggcaaagttcgtccgacgcggtcttgaggtaatcgccgatgcgtccccagcgcgaggcccgcgccagggcggcgcccacgccgcgcacgcccctgggggggtaatgcatggccgccaccgtggcggcggcctgttccggcgtatcgatcatggggaccagcagggtctgggcgccgatatcgagcaattgcttgatcagcgcagtgtcgccgatcaccggacgcacgatggggtggctgggatagggcgccaccgcctgcaactgggccagcaggccgggcacgtcgttgggggcgtgctcgccatcaatcagcagccagtcgaagccggcgccggcgcagatttccgccgtatagggattggcaaggccaacccacaggccgatctgggggcggccctcggccagggcgcgcttgaagggattggcgggtgtgggcatgggcgggctctccttgatgtcatcctgagcgtagcgaaggatctccgcttggcacgatggtgccggtttatgaaaagacctgccagaatgagatccctcggcttgcgcctcgggatgacaggtcagatagccctacacgaaccggcaggcgatggcgcccagcgggccgtaatccacatggaaggtgtcgccggcccgcgccggcaccgggcgagtgaaggagccggccagcaccacctgccccggctccaacgcgatgctgtggggggcgaacttgcgggccagccaggaaatgccgtgggccggatggttcagcaccccggcggcgacgccggtttcctcgatcaccccgttcctgtacatgatggccgccacccagcgcaggtccacgtccatgggcctgaccggccggccgcccatgacgatgccggcattggcggcgttgtcggagatggtgtcgaacaccttgcgcggccgcttggtctcggggtcgaggcggtggcagcgggcgtcgatgatctccagcgccggaatgacgtaatcggtggccgacagcacctgggtcagggtgacgtcggggccttccagccggtctttcaggatgaaggccagttccacctcgaccatggggacgatgaagcgcgccatgggaatgtcggtgccttcgccgaacaccatgtcgtcgagcagggtgccgtaatcgggctcgtcgatctgcgacgattgctgcatggcccgcgaggtcaggccgatcttgtggcccaccaccttgcggccctcattgatcttggtctcgacccaagccttttgcaccgcgtaggcgtcggccatgcccatctcggggtggtccagcgaaatctggccgcactggtgtcgggtctgctcggcccgatgcaggcgggcggcggcggcattgatctgatcgagcgtgagagccatgggtcaagccttcctgaaacgggcgtggacgttgttcttcttgaaggtgccgccctcgtcgaactcgtagagctccatggagagcgcgaaatagccgctgtcgtaaagaggggcgaagtggtccgtcatcatggcgaacagctcctcgcaggccttcttcttctcggcgtcgctgcgtccggcgccgatcttgagcgtgcagtggacgaagccgtaatcctcctcgtcgtcggccatcacatagtcgtgcaactcgatggcgcgggcgcggatgccgccgatggggaaaacgccgccctgggcgatcagcacctggttgaccttcttcagcattccccggatgtcggcccggtccttgatgttgtcggtgtactcggcgatgaagtggggcatgtgtctcctcgcgcaaatttgaatgtcatcccgacgacctgcgggaggagggatctcgtcctggaacggcgtgtccaagttggcttcaccgttccaggcggagatccctcgccggcgctcgggatgacaggttgtgcaaatcaggcggcgacggggaagaccgcgttgacctggccggttccggccgcctcgaaatagggagtgacgatctcgacgccgcgatcgtacttgtcccaacccagggcgcccagcagcatggcggtgtcgtgcatcaggccctcgccgtggcaggtcttggcgtagagcggcagcatgtcggtgaattccttgaagcgcccttccttccacaggtccaacgcccgcaggtccacctgcttgtagaactcgttggagatggtgaagaagtgatccatggtcttcagcgtcgtgttgggatggatggcgtgggacagcgagcccgaggcgacgatggcgaaattgccgtccatgcgccggatggcctcgcggatggcctcgcccaccttggcggattccatgtggtcgtggacggtgcacaggcaggccaccgacaccaccttgaagccgtattccttggcgcccatcagccacatgggaatcagggtgccgtattccagctccaggcttgcgatgtggtgcgagcgcacggtgacgcccttttcctcggtggcgatcttggcgatcaggtcgctcatctccgggttgccctcgtgctcatagggcatgtcggccagcagatgggggaactcgttggaggtgaacacgcccttgaaatgggcgttgccgttgatgtgataggcgttgttcaccagccaatgggtgtcgagcacgatgacggtgtcgacgcccaggtccttcatgcgcttgcccatggcgcggtggccgtccacggcggactggcggcagcccttgaaggggccttcctgctcggacaggtacatggtggggacgtgagccaccttggcggcgaaaaccagattacccattttggacgctcctctctctcgttgaaactctgccctgaacacgtttgttttggcggcccttgcctcgacgtgtcatcccgacgcccttgggcggagggatctccgcctggagcgatggtgcccgacgggacacatcgttccaggatgggatccctcgcctgggctcgggatgacagggggcgtccggccttcacacgccccagcgggggatgtggtggcttcccttggagacgcagacgttcttgacctccaggaaggcctcgtaggagtagtggccgccctcgcggccggtgcccgagcccttgatgccgccgaagggctggcgcaggtcgcggacattctgggaattgacgaagaccagaccggcctcgatgccctcggccatgcggatggctcgcgccccgttctcggtccagacgtaggaggccaggccgtagctggtggcgttggcgatcttcagggcctcggcctcatccttgaagcggatgacgcaggccacgggtccgaagatctcctcctgggcgacgcgccaggaattgtccacgtcggccagcacggtgggacgcacgaaattgccgttcttcagatggggggccaggccttccggcgtgcccaggccgccggccaccacacgggcgccttcgctgatccccagctcgatataggaggtgaccttcttccagtgatcgcgggtgatcatgggacccacattggtggcctcgtccaagggatcgcccaccaccaccttccgggtgcgctcggccagggcggcgacgaagcggtcgtagaggccgtcctggaccaggatgcgggtgccgttggtgcagctttcgccgttattgccgtagacggcgacgatggcggcgtcgacggcacgctcgaagtcgcaatcgtcgaagatgatgttgggcgacttgccgcccagctccatggagtacttcttgaggccccccgactggatgatgcggttgccggtggcggtggagccggtgaacgacacgccgcgcacgtccgggtgcttgaccagggcttcgcccaccgcagaaccatagccgtggacgatgttgaacacaccggcggggatgcccgcttccagaatcagctggcccagccggtcggccgacagcggcgacagctcgctcatcttcaagacggcggtattgccgaaggccaggcacggcgcggtcttccaggtggcggtcatgaatggcacgttccacggggaaatcaggccgaccacgcccaccggctggtacagggtgtagttcaggtgatcgttggtgggataggtctcgccgtccacatggcaacaggtgtcggcgaagaaatagaaattgtcggcggcgcgcggcaccagcatcttcttggtgcgccagtaggactggccggtatccaggctttccagcttggcgatctcgtccacatgctggttgatcaggtcgcccaccttgcgcagcagcttggcgcgctgggatgcgggaaggcccgcccatttggggaaggcttccttggcggcggccacggcctgggccacttcggcctcgccgccggcggcgatctggcagatcacctcgttgttggcggggttgagattggcgatggtggaggcgctctccacctggcggccgttgatgaggtgcttgatcatcgggttcagctccgctggaaataggtctcgtcgtcgacgatgaaactggtcaggcgtccgacgccctcgacctcggtcaccacctcgtcgccgggcttgacgtcgacgatgccgtcgggggtgccggtgaggatcaggtcgccgggcgacagggtcatgaaggacgacaggtattcgatcagggcgggcaccccgaacaccatgtcccgcgtgttgccggactggacccgggcgccgttgacgaaggtggagatgtcgaggctcatgggatcggctacgtcgtcgcggtccaccatccacggcccgagaacggtgcagccgtcgcggttcttggtgcgcaggttggggcggtagtagttctgcaggaagttgcggatggcgtagtcgttggccacggtgtagcccgccacgaagtcgtaggcgtccttggccttgacgtcgcgggcggtgcggccgatcactaccgccaactcgcactcgtagtgcatgaagccggcgtcggcgggcttgcgcgtcaccgcacggtggccgacgaaggtgcccggccccttgaggaaggccagcggcttctccggcgccttgaaggccagctccttggcgtggtcggcatagttgatggccagggcgaaggtggtgccgggggcgacggggggcagccacaccacgctttcctcggcgacccggcggccgtcggccaggacgaccacattgccgtcctcgactcgggcgtcgtgaatggcgccgttataggcgattcgggcgcgcttcatgccgattcctccgcgatggtgcagtccagggcgccgatgccgtcgatctcgacccgcaccgtgtcgccgcgtccggcggtgggcaccgcgcccaccggatagcccagggtcaggacgtcgcctgccgacagggccatgaagtcggtgacctcggccaccagcttggcgggagagcggtagaggtcgtccagccggcgctcggcgaccttgtcgccgttgacataggtgcggatggacagggaggagaggtcggcgggcaggtccgccttgtccaccacccaggggccgaccgggcaggcgccgtcgaagcacttttcctgcaccggcgggcgatagacgctgtcgttgggcaccgacaggtccagcacgatggtcaggccggtgacgttgtccagggcctcggcctcggcggcccgcgccgtctggcggccgaacaccaggcccagcgaggcgcccagctcgacgcgtgcggcagtggcgggcagccgcaccgtgccgccatggccgagatgggtgttccgcggcttgaagtacagcaccggcacggtgggcggcgccttgtagggatcggcgttgagcttgtcgccgaaccgctcccaggtggagcgctcgttgagcagcgggccgtagatccagccctccaccgggggcgcgaagccgcccggggggatggggaggattcggccgcccaggtccaggccggtgccgtcgggggtgacggctccgctgatgggcgcggcggtgccggggaagttgatgcgggcgtgacgcatgattgctttcctcagggatcagccggtgacgtggaccagccacagggccatgggcgggaagaacaccaggaccacgatgcggatgaagtccgaggccaggaagggcagcacccccatggcggtttccttcaagggcacgtccttggcgatcttgttgatgacgtagaggttcatgcccaccggcggatggaccaggccgatctcgaccaccatcagggcgacgatgccgaaccagatggacttgtcgtcgacgctcatgccgtagaaatccaggcccagcaccaccggatagaagatggggatggtcagcaggatcatggccagcgagtccatgacgcagcccaacagcacatagatggcgatgatggtgaacaacacggccaccggcggcatgccgctgttcttcacccaattggccagttcggcgggcatctgggtcagcgccagggccgagttcaggagatcggcgccgatcagcaccatgaagatcatggcggtggcgatggcggtgccgaatacgctctgcttcaggtccttgaagcgcatgccgcccgacaccacggcgatgatgccgcaggccgccgcgccgatggaggcggcctcggtgggattggcccagccgccatagatgccgacgatcaccaccaggaagaccagcagcaccggaatgatgcccagctgggccttgatcatctccttgagcgagacccgctcgctggccggaccggccttggggtccaggctgacgatgatgcggatcaccgccatatagcccagggcggcgatgatgccggggatgacggcggccacgaacagcttgccgatgctctcctgggtcagcaccgcatagaccaccagcggcaccgagggcgggatcaggatgcccagcgtgccgccggccgcaagggtgccggtggccagacggccggaatagttgcgccgggtcagctcgggcagcgccacctgccccatggtggcggcggtggccagcgacgagccgcagatggccccaaaggcggcgcaggcggcggtggcggcataggccagcccgcccttgaagtggccgatcaaggtgccggcggcatggaacagggccttggacagcccgccatgggtggcgaactggcccatcaggatgaacagcggaatcaccgccaggtcgtaattggacagccgggcgtagaccagattgttcagggtgaacagcagcgagttcagttcaccgtggttcagcaccagatagatgccggtggcggccaggaacatggcgattccgatgtggatgcgcaccaccagcatcagcagcaggatgccgaaggcggtcaggccgagggtggtgccgctcatgacggaatctccagtccgacggtgaattcaagggcggtgcggtagatggcgcagatgccggtgagcgccagactcggcaccatcagcagcacgggaatccactggggcactgccagcaggggcgaaacctcgccggtatcgaggccgtccagggcctggaagccggtgcgccaggccagcacggccaggaccagggccagcagggaatcgcccaccgcgtcgaagcggcgcttgaccttgggacggaagccctcggtgaagaactcgacgcgcaggtgatcgccccgcagcgtgcacagcgggatgaaggcggccgccgcgatggcgttgcccatctgcatcatttccacgtcgccgttgacgggctggaagcccagcttgcggctgatgatggagatcagcgacatgatcaccatggccaccagggtggccccgccggtccaggccatggcctcggcggcgcggttgagccagcggtcgatgacgtcgtgagcgcggcgctccgccggcggatagaggagttccgtcatgggacgagtccttatgcgcgagtgcgggtggagatcagttctgggccgggaaatacttggccgaaagcgcgcgggcgcccgccgccagggcctgtccgtccagcttgcgggcggtgacgtccttgacccattcctcctccaccggcttggccgcgtcgcgcatggcctggtagggggcgggctccaggttggtcacctgggtgccgggaatggtggcggcgtatttcaggttggcggcggtgacgtcgtcccagaccttgccgaaggcttccaccagcaccgggccggaattgcggtcgatcaccgccttgaggtcggcgggcagcgagtcgtacttggccttgttcatcagcaccgacagcacggtggccaccgggaaggggcggccgggaggcggggcgatgtggtacttggtgacctcgtcgatcttggtcgggcgcatcagctcccacggcagcaggccgccgtcgaccacgcccttggcgatggcgtcggccacctgggacggcggcatggagaccggcacgccgcccagcgactgcagggtcttggccgccaggcgggtgggggtgcgcagcttcaggcccttgacctcggccaggctcttcacctcggtattggcggtgtggaacagcccgccgccgtcaatgtgaaccgccagcaccttgtaggcggcgaattcgtccttggcgaactggttgtagtagtcccaggtcatgcggctgccgtccagggcgttggccaccatgaagggcagctccagcgcctcgatggccgggaagcggccggcggaatagcccggcgccgtccacacgatgtcggccacgccgttcctcacctgatccaccagttgcgacggcgtgccgcccaattgcatggcgggaaagatctgacacttgatgcggttgcccgattcggcggcgacacggtcgcaccacgggccgatcacctgggcatgggccggggccacgggcggcaggaaatgggcgaatttcagcaccacctcgtcggccgccgccgcctgatgggcgaagggcagggcgccaagaagggcggcaaggctgagggcaaggctcctgatacgcatggtttcctccgtgttgagccgcattcgggcaagtgcggccggggacatggcccggaccgtcatgttagttaacatgcgctgtgtagttaacatgttagcaaacacgatctcactatcatgttagtgagtcaacggccaagttgggttgacctggaggatttgcggcgcgaccatggccgggccacgttcgggggaacacgcgttgagcaccgaggcctttcatcccaatctgccgctgttgctggcccaggcgcgcgaagagatcatttcgcgctttcggcccatcctgaatcacttcggggtgaccgagcagcagtggcgcatcctgcgcgtgctgcggcatgaagagccgctggagccgcgccagatctgcgacatctgccttttcttaagccccagcctgaccggcgtgctggctcgcatggaggagatggatctggtccgcaaggaacgggtggaaagcgatcatcgccgcgttctggttcacatgacggagaaaagccgcgccctggtggatgccgccattcccctgatcaccgagcagtaccgccatatcgaagacgtcattggcgccaagcagacggtcgagctatacgatgttttgacgaagctgacggcgctgcacggcgccgccattcccctggtcaaactgcccagcaagtgagccttccatgtttcctgacaatctgctgccggtcttcgaccggaccgacgtgatcttcgagcagggcgagggggcgtggctgaccgcctccgatggccgccgcttcctggatttcggcgcgggcgtggcggtcaacgccctgggccatgcccatccccgtctggtggcggcgctggaggcgcaggcgggcaagctgtggcattgctccaacctctaccgggtgccgggacaggaacgggtggccgaacgcctgatcaaggcctccttcgccgacacggcgttcttctgtaataccggcgccgaggccatggagctggtgatcaagatcgcccggcgctatcaccactgcgccggacgccccgagcgcaaccgcatcgtcgcctgcaccggcagcttccacggccgcaccatcgccaccctggcggcggcgggaactcctaagtatctggagggcttcggcccggtggcccagggcttcgaccacgtgccctatggcgatctggaggcggcgcggggcgccatcggctccaataccgccgccctgctggtcgagccggtgcagggcgagggcggtatccgcccggccgatccggcttacctccggggcctgcgcgccctggccgaccagttcggcctgctgctgctcatggacgaggtgcagaccggcatcgggcgcaccggtaagctgttcgcccatgaatggtcgggcatcgcccccgacgtcatgggactggccaagggcctgggcggcggctttccggtgggcgccgtgctggccacggaaaaggcggcgtcgtgcatgacgcccggcacccatggctgcaccttcggcggcaaccccctggccatggcggtggccgaggcggtgctggacgaggtcatggcgccgggcttcctggagcgggtgcaggcggtggccgccctgctgcgcggcaggctcgacgatctggcccgccgctatcccggcgcgatcgcccaggtgcgcggccaggggctgatgctgggactgaagaccgtgccggtgaataccgagttcaacgccaagctcttcgccgccggcttgctggcggtgggggccggtgacaacgtggtgcgcctggtgccgccgctgatcatcggcgaggccgaggtggagcgggcggtggagatcatcgacggggtgtgtcgggggtaaaggcgcgtatccctctgcctgtcatcccgggcacccgcgagggatctcatcctgatccggcttttcagaaccggctctgtgcgagcaggcggagatccctcgccatcgctcgggatgacgatggcgtcaggcgaggatggccagcccggcggcggcgatctcgcaatcctcgtcctcggtggcgccggaaatgccgatggcgcccgtgacatcgccgtccctcagcaccggcacgccgccgccgatgggaatgaagccgtcgcggcccgacaagccttccagcacgtgggggcgggtgccgatgcggtccttccactgggcggtgggcttgccgaagccggcggcggtgcgagccttgtcggtggagatggtcaccccatgaaagggggcgccatccatgcggaccagggccttcagatggccgcccgcgtccacggcgacggcggtgaccctgacgcccatgctccgcgccttggcgatggcggcggtgacggcggccagggcctgctcctcggtcatgacaatcctccgatgcagacgtatttggtctccatgaagtcgtcgaggccgtatttggagccctcgcggcccaggccggattccttgatgccgccgaagggggcgacctcgttggagatcagggattcgttgacgcccaccatgccgcattccagggcctcggccacccggaacacccgggccacgtcgcgggaataaaaatagcccgccagcccgaattccgaggcattggccagggcgatggcctcggcctcggtctcgaagcgcagcaggggggccaccgggccgaaggtctcttcccggaaacacagcatggcgggggtcacgtcggccaggacggtgggttgccagaagccgcctcccagggcgtggggccgtccgccggtcagcacgcgcgcccccttggacaccgcatcggccacatgggcggccaccttggcgacggcggcggcgttgatcagcgggccttgttgcaccacgccggacaaggcgtgtccaaccgccatggcggcggccttctccgccagcttgacggcaaagtcctcgtagattcccgcctgcaccagaaagcggttggtgcagatgcaggtctggccggaattgcggtacttcgacgccagggcgccggcaaccgccgcgtccaggtcgcaatcgtcgaagacgatgaagggggcgttgccgcccagttccaggctgaccttcttcaccgtctcggcgcattgggccatcagcagcttgcccactcgggtggagccggtgaaggacagcttgcgcaccttggcgttgccggtcatctcgccccccaccgccgccggctggcgggtggtgacgatgttgaacagacccttgggcagaccggcccggtgggccagttcggccagggccagggcggagagcggcgtgtcctcggcgggcttgaccaccaccgggcagccggcggccaaggcgggggcgcatttgcgggtgatcatggccatggggaagttccagggcgtcaccgccgccaccacgccgatgggctgcttcatcaccagcaggcggcggtcgctggcggtggtggggatcaggtcgccataggcccgcttgccctcctcggcgaaccacgagatgaacgaggcgccataggagatctcgcccatggcctcggccaggggcttgccctgttccgccgacagcagccgggccagggcgtcctggtgggccatgatcagatcatgccaggccatcattaccgcggcgcggtccttggcggtgcgttgccgccagggattccaggcggcctccgccgcgtcgatggcgcgccgggtctcggtcgcgcccaggtcgggaacgctggcgatcaacccgccggtggccgggtcgagcacgtcgaaacggcgcccgtcatcggccccgacccaaacgccatccacataggcatgggacttgatcaggctgggatcgagatcggtcacggcggctctcccggataaagttaacacgttaaatactaacatagtagttacatccgacccccgcttatgtcaagctccgctccgccaccctcaagggtggcctttacgaagtcggaacacgatgacaccatctcaatctctgtcccgatccccgggcttctttggcgacgacgtcatgtcaggaaagcttcccctcagccccgaagagctgacccggctgcgggcgttttcgcggtccttgccgctggccttgctgaaggctcgcgaagacgtgatggcgggctttcgccccaatctgcgcagccacgacattaccgagcagcaatggcgggccttgaaggccctggcccagaccggcgaaatgcgggcgggccagctgtcgcgggccagcctgatcagcatgcccagcctgacccgcatcatccgcaccctggaaaagcaggggctgatcgagcgccggccggaggagcgcgaccagcgcgccgccttgctgtcgttgaccgccaagggtcacgatctggtgctgtcggtcagccatgcggcggaaaagcgctacgacgagatcgtcgccgccttcggcctggagcgcctggaacgcctgcacctgatgctggacgaattgtcggcggcactggcgaagtaggtgctccgactgtcatcccgagagaagcgagggatctccgcctggcagagggatgccgatacggcaccgtcgggccaggatgagatccttcgtcgcgatgctcctcaggatgacaggcggagggggcgaacgctcacaccaccccgttctccctcaaccgttccatctcgtccgcccccatccccagccatccgcccagcacctcggcggtgtcggcgcccagcaggggcggggcgcggtcggacagggcctgggcgccgtcgaagcggatggggttggccaccagatcgatgccgccggccagggggtggtccaggcgggtcctgaggccgcgatggatcacctggggatcggcgaacacgttggccagatcgttgatggggccgcagggcaccccggcctcctccagttcggcgatccatcgggcggaggggcgcgacgtcagcagggcttcgaggagggggaccagctcggcgcggttccttacccgctccacattggtggcgaagcggggatcggcgcccagttcgggccgcccggcggtgtggcagaagcggcggaactggccgtcattgcccaccgccaggatgatatggccgtcggcggtggcgaaggcctgatagggcacgatgttgggatgggcgttgcccagccgcttcggcgtggcgccgcccaccagataattggtggcctgattggccagcaccgccacctgcacatccagcagggcgaggtcgatctggctgccctcgcccgtgcggtcgcgcttggccagggcggcgaggatggcgaagccggcatacatgccggtgaagatgtcggtcagcgccacgcccaccttcatgggctggccgccgggctcgccggtcaggctcatcagcccgcccatgccctggatcaggaagtcgtagccggcccgctgggcatagggtccgtcctggccgaagccggtgatggagcaatagaccaggtcgggcttgaccgccttcaggctggcatagtccaggccgtatttggccaggccgcccaccttgaaattctccagcaccacgtcggatctggcggccagacgccgcaccagttcctggccctgggcttgagtgaagtcgatggtcaccgagcgcttgccccggttggccgacaggaaataggcggcctcgccggtgtcgccgccctggccgtccttcaagaagggcggcccccagccgcgggtgtcgtcaccctcgcccggacgctccaccttgatgacctcggcccccatgtcggccagcaactggcccgcccagggaccggccagaacccgactgaggtcgagaacgcgaagatgcgataagggtccggtcatggggcgcccatccgtgcaggggaagtcgccacatgcttaccaagttaattactaatatagaagcaaattattgactctggctggcctgaggctggcgcgagacgcaaaagctttcctgaatttcggcgaagatcagcatcaattgggcctgcacccagtcgatgaactcgtgcaggccgtggtcgatgacctgatcgatggtgtgatcggtcagggcggcgcgcagcccgtccagcagttccagcgcccggacaccgccccgcaggttgtagcgcgagcgcaactgggtcagcagccagtccatctggcgcacgcacagaatcaccgagcgcgggaaggaatccgagaacagcaggaaggccgccaccgaacgcggcgtgatcttgcccgccatcacccggcgcgacgcctgatagccggccactgccttcagcagggcgttccagtggctgatatccagcgccgagcccacgtcctcgggccggggcagcagggtatggtacttgatgtccagcaggcgggtggtctggtcggcgcgctcgatggacttgcccaggtgatagaagtagtgggcctgatcgcggtagaaggtgccttcggtgatgcccacgtgcaactggcaggcctccttgatctcctcgcacagggcgacgagattggccggcgccacggcattggccgacaggccgcccatccaggtgttcatgcggttgatctggcgccacatctcgatggagatcatggggcgcagcgtccgcgcattctcgcgcgccgccttgaccgaggacaggatggaattggggttgtccgggtccaggatgtagaagtgcggcaccgtgcgcgcatcggcgacccgatggcgggcgaagaagcgttcctcgtcggcgttgatctgcaccaccgccagccagttgcgcccggcgcggtcgcgggcgaaggtctcggccacgcccaggatgcgggccagattctcggcccgctccatgtagcgggccagccagacgatgcaatcggcattgcgtgccagcaactcgctcattggccttctcccgccagaacccaggtatccttggaaccgcccccctgggacgagttgaccaccagcgagccttccttcatggccacgcgggtcaggccgccggccagcaccttggtcgacgcgccggtgaccgcgaaggggcggaagtccacgtggcgcggctgagtacccttggtcgtcagcgtcgggctgaccgacaggccgatcatgggctggctgatgtaattggccgggtcggccttcagcttggcgcggaactcgtcgatctcggaccggctggccttggggccgagaatcatgccgtagccgcccgattcgcccaccggcttgaccaccagatgctccaggttgtccagggtgtatttcagcccctcggcctcgcggcagatgaaggtctcgacgttgggcaggatggcgtcctcgcccaggtagtacttgatgacgcgcggcatgtaggcatagaccgccttgtcgtcggccacgccggtgcccggcgcattggccagggacacgttgcccttgcggtaggcgtccatcagccccggcacgcccagcatggaatcggggcggaagaccttggggtcgaggaagaagtcgtcgatgcggcgatagatgctgtgcaccggcgccttgccggcggtggtcagcatgtagacccggtcgttctccaccaccagatcgcggccttccaccaggggcacacccatctcgcgggccaggaagacgtgctcgaagaaggcggagttgtagatgcccggcgacagcagcaccacggaaggctcgtcgacgccggccggcgcgatctcctccagcgcccggcgcagcatcaggccgtaatcgtccacggcgcggacccgggtgtcttccatcaggtcgggaaaacactgcagcatcaggttgcggttctcgaccacgtaggacacgcccgacggcgtgcgggcattgtcctccagcacccggaacaggccttcctggtcgcggatcaggtcgatgccgcagacgtgggaataggtgccgcacggcaccttcagcccgcgcatgaaggcatggaaattggcgttgcccagcaccagatcggcggggacgatcttgtcggccaggatcttctggtcgccgtagagatcggccaggaacaggttgatggcggtgacccgctggatgatgccggcctcgaggcgggaccactcgcccgccgtgatgacgcggggcagcacgtcgaagggcaagatgcggtcgatggcgtccttgtcggaatagacggtgaaggtgatgcctaagtcgaacagctccttttccgcccgcgcggcgcggtggcgcaaatcctcggggtcgagtgcgttcagccgggcggcgatggcggccaactcggcctcgccgtcaccgcgcagcgacagcgcctcgcagaagaattcggcgggatcatagcccgacaacaggccgggttcgggtagggtcagtcgtggccgggtcatactttcgatccccctctccgcgcccctgaatatggcgcggggtgcagtttatcgcgccatttcgaattgatcaaatttaaggcacgcatggcagcatgctgaaagatgaagcttttactgcaacctgacctcgggctctatgctaccctgttcgctgcatctcgccactgtcttcggatgatcatgggcattcacgtcaagctgcgccataccacacgttataagtatgaccgaccggtcgttctttcgccccaggtggtgcggctgcgcccggcgccccatgcccgtacgccggtgctgtcctattccctggacgtggagcccaaggggcacttcatcaactggcagcaggacccccagggcaactggctggcccggctggtcttccccgagaaggtggaatccttcacggtggatgtggacctggtggccgacctgtcggtggtcaatcccttcgacttcttcctggagcccgaggcggagaatttccccttcgcctacgacccgctgctggaccacgaactgaagccgttcctgaatcgcgaggaggcggggccgctgctggccgattacgtggcctccatcgacacaagcacgcccatgcagaccaccaatttcctggtggcgctgaaccagcggctgcaggacgacatcagctacaccatccgcatggagccgggcgtccagaccccggaacagaccctgggcctgaagaagggctcgtgccgcgattccgcctggctgctggtgcagattctgcgccgcctagggttggcggcgcgtttcgtctcgggctacctgattcagctggtccccgacgtcaagccgctggacggccccgccggggcggcggaggacttcaccgacctgcacgcctggaccgaggtctacctgcccggcgccggctggatcggccttgaccccacctcgggcctgctgaccggcgaggggcatattccgctggccgcctcgcccgatcccaccagcgcggcgcctatcaccggcgcggtggagatgtgcgaggtctcgttcgagcaccatatgggcgtcgcccgcgtgctggagaccccccgtgtcaccaagccctacagcgaggaccagtggcaggccgtgctggaactcggcgatctggtggacgagaagctgcgccaaggtgacgtgcgcctgacccagggcggcgagcccaccttcatctccaccaccgacccggatggcgaggagtggaacaccagcgccgtcggccccaccaagcgggccttcgccgacaccctgatccgccgtctgcgcgaccgcttcgcgcccggtgcgctgatcgcttatggccagggcaagtggtatccgggcgaaagcctgccgcgctgggccttctcgctgatctggcgcgacgacgacgaggtggtgtggcgcgacccgcggctgatcgccctggaggccgaggacaattcccccacccatgaacaggcccgcgacttttcccaggcgctgtgtcgccatctgggcgtcgacgccgatttcgccatgcccgcctgggaggacccggcctattacctgctgcgggaacaggccctgcccatcaacgtcgatcccatcgattccaagctggaaaacccggaggagcgcgcccggctggccacggtgttcaagcgcggcctgggcacgcccaccggctatgtcctgccgctgcagccctggcaggccaaggataagttccgctggatcaccgggccgtggccgacccgggacggcaagctgttgaccattccgggcgattcgccgctgggcctgcggctgccgctggaatccctaccgtggattcccgccgacgcctatccctatcacagcgagcgcgatcccttcgagccgcgtggccccatgcccccggcccggcgccagcgcgcccagaccgagcaggtcccgggctccggcgcgcccaaggccacggtgctgcagcaggtgccggtggatctgcgccccgtcgagaccgccaagggactggtgtccgaaaatgtgcgcaccgccttgtgcgtccagccccgcgacggccgcctcaacgtcttcctgccgccggtggaaaccgccgagcagtatctcgacctgatcgaggcggtggagctgtccgccgccgagatcggcaccccggtgcatgtggaaggctatccgccgcccaacgatccccgcctgaagatcatcaaggtgacgcccgatcccggcgtcatcgaggtcaacgtccagccggtggagcactggcgcgaactggtgaccaacaccgagatcctttacgacgaggcccatcaggcccgcctgggcaccgagaagttcatgatcgacggccgccatgtgggcaccggcggcggcaaccacatggtgctgggcggctggacgcccgccgacagcccctttctgcgccgtcccgacctgctgggcagcctgatccgcttctggcagaaccatcccagcctgtcctatttgttctcgggcatgttcatcggccccaccagccagcatccccgggtggacgaggctcgcgacgacacgctctacgagctggagatcgcgctgtcccaactgccccaccgggggaccaacgtggcgccctgggtggtggaccgggtgctccggaacgtgctgatcgacgccagcggcaatacccaccgcaccgagatctgcatcgacaagctctactcccccgacggccccaccgggcgcctggggctggtggagttccgcgccttcgagatgccgccccatgcccgcatgagcctggtgcagcaattgttgctgcgcgccctgatcgctcgcttctgggacgagccctatatggagaagctggtgcgcttcggctcaagcttgcgcgaccgcttcatgctgccccattggatcgagaaggatctggacgaggtgctggaatggcttgacgcgggcggcatccatttcgaccgggcgtggttcgccccccatctggaattccgcttccaggcggtgggcgccgtcacccatcgcggcatgcgcatcgaattgcgcaccgccctggagccctggcatgtcatgggcgaggagcccggggccggcggcacggtgcgctatgtggattcctcggtggagcgcctgcaggtcaaggtcaccggcctggtgggcgaccgctatgtggtggcctgtcacggccgccgcctgccgctggcgcccaccggcgcctcgggggaatgggtggccgggctgcgctatcgcgcctggaagccggcgtcctgcctgcaccccaccatcggcacccatacgcccctggtcttcgatctggtggacacctggaccggcgaggcggtggccggctgcacctaccatgtcgcccatcccggcgggcgcagctacgacaccttcccggtcaattcctatgaggccgaggcccggcgccgggcccgcttcttcgccttcggccattcccacgggccgcttcgggtggagagtggcaccatccatcccgactacccaaatacactggacctgaggctacaataggcgctaacaccacgaaacagaccgtcatcccgacgaccggagggaggagggatctccgcctggggcatgggtgccgggtggagaacatcgtatcaggatgagatccctcgcattcgctcgggataacagggtgaaacgacaccgtcgcgattttgggggaggggaaaataccgcgtcgcctgcgctctcgtcttgaaggtccgccctggagtttcgaagacgcctatcgtccgctgccgggagccttcgacgaggtgaaggcgccgggcggaggcgtccgtccccattggcagggctttgtcgagggtatgaaccgcctgggcctcgaggaggtcacccggcgctgggacgtgggccagcgcctgatccgcgacaacggcgtcacctataacgtctatggcgacccggcgggcctggaccggccgtggcggctcgaccccctgccgctgatcctgtcggcggaggaatggtcggccatcgccgagggcatcgagcagcgggccagcctcctggattccgtgctggccgacctttacggcgagcggaccctggtggggcgcggcgtcattccctcgtcgctgctgcacgccaatcccgcctttctgcgcccctgccatggctggctgccggcgggcggccactggctgcaccattacgccgccgacctggtgcgcggccccgatggccagtggcgggtgttgagcgaccgcaccgagactccttccggggccggctatgccctggaaaaccgctccattgtcagccgggtgctgtccgagttccaccgctcgctccaggtggagcggctggggccgttcttcgagacgcagcgccgcacgctgcaggggctggcggtgcgccaccgcgacgacccgcgcatggtgctgctgacccccggcccctacaacgccacctatttcgagcatgccttcctggcccgccagctgggcatcaccctggtgcagggcgaggatctgacggtgcgcgacaacaccgtctacctcaaggccctgaccggcctgcagcaggtggacgtgatcttccgccgcactggcggcacgtggtgcgaccccctggaactgcgcggcgattcccaactgggggtggcggggctgctgcaatcggcgcggcgcggcaatgtgtcgctgttcaacgccatcggcagcggcctgctggacggggcctcgctgctgggcttcatgcccgccctggcccggtcgctcagggacgagcatctgctgctgccctcggtgcccagctggtggtgcggcgaacccgccgccctggaccatgtgctggccaatctgtcgcgtctggtgatccgccccgccttcgggcggcgcgaccagccggtgatcggcgccgctttgtccggggtgcagctggccgagatgcgcaacgccatcctggcgcgtccctgggactgggtcggccaggaggtgaagaccacctcgaccctgccgctgtgggccgaagggcggatggagccccgccattgcgtgctgcgcgtcttcgccgtccacaccgagaagggctggcaggccatgcccggcggcctggcccggctgtcgtccgagcgcgacctgctggcgtcgcggctgcagaccggcggcggcggcagcaaggacgtctggatcgcctcgccgacccagcgcctgacggtgaccaccgcccggccgcaggtgccgccggtgcggctgacccgcgagaaccgcgacctgccgtcgcgggtggccgacaacatgttctggctgggccgctatctcgagcgctgcgaggccaccacccgcctgctgcgcgccgccctgatccgcatcgaggatgccctggccgagggcgattccgtgcgggcccaggccatgatccgcgtcatgaccgcgctgggcctgtcggtgcccgaggacgaggacgaccagccggccgaaagcctgaccgaccggttggtcgcccatcacctgtcggtggagggggccgggctggccggctgtgtcgagcgcctgctgcgcatcgtcgtccatctgcgcgaccgtctgtccaacgacacctggcgcgccctgcatcagctccgggacgagatcggcctgctggccgccgagaccggcggcggcgacgtgatgggccggctcaacgccatggtgctgaccatgcaggcggtcagcggcctggccatggagaacatgacccgggggccgcaatggctgttcctggattccggccgccgcgccgagcgcgccatcgccatggtggaaatggtcagcggcgccctggccgacgtggacggcgaggaggcggtgccgctggatctgctgctggagatctgggacagcgtgatgacctaccgctcgcgctatctgtccacgccgcgtctggcgggcgtgctcgacctgctgctgtgcgacgagggcaatccccgctcgctgggcttccaactggccaccctggaaggccacatgaaccggctggccgccatgggcgagcattcgggcttctacaagccggagcagaagctgatgaccgtgctgtgcggcaccatccgcaccaccgacgtcatggtgatttcccgcttcgaccgcgacggcggctatcacgacgccctgcgcctgctcgacatgctgcgctcgcggctgtgggaattgtccgagcaggtgtcgcgcacctacttcatccacgcccagtggcggctgcccacagcgcccatggaggaactggcgtgaagttcaaggttcgccacaccaccacctacaaatacaccgagccggtgcaactgtcccaccacgcggcccatttgcagccgcgcaccgtggacggccagagcgtgggacaggtcaaggtgaccatccgccccagtccggaggtgctcgacgagggcggccgcgactatttcggcaatcccatcaccttcttcaccatccagagcccccattccaccctggtgatcgacgcctccttcgtggtggagaccgccggccagccgaggctgccccagatcgcggttcccgcctgggattccgtgcggctcaacacctggtcgggggcgcggggcatcgatgaatcggtgatggatttcgtcttcgcctcgccccaggtgccgcccctggccgaggccgagcgcttcgccctgcccagtttcccccccggccgtcccctggacgaggcggtgatggatctgaaccaccgcatccacagcgaattcaccttcgatcccgaggccaccaccgtgggcacccccctggcgcaggtgttccagcagcgccgcggcgtctgccaggacttcgcccatgtgggcatcgcctgcctgcgggccatggggctggcggcgcgctatgtcagcggctatatccgcaccaagccgccgccgggcaaggaaaagctggtgggcgccgatgcctcccacgcctggctgtcggtctaccagcccggctggggctggctggatctcgatcccaccaacgacatggccgccggccaggatcacatcgtggtggcctggggccgcgactacgacgacgtcaccccggtgcgcggcgtggtgctgggcggcggcgagcatcaggtgctggtggccgtcgacgtgctggagatgtagtggcccggcctgggtcctgggctactcgtagcgcttgatgtccagcttttccggggtatcggccaccagttgcagggcgatggtcccgttgtcggtgcgaagcagcaattccaggaaccaagtgccatcctccagctccatgggctgggcggcgccgatatagctgacaccttcgacgtccatgctgaggctgtggttgtcgttgaatgaaatggccgcgaccttcatggtcgaacactcctgtctgggcgcggtgcaagactcccccaaatgccgggcgccgtcaatgcgttgcgaggcctcgggcggcggctcgtgaggccggcagggccaccatgaagcgcgagccggcgccttcctccgattccacccagatgcggccgccatgggtggtgacgattttgcgacagatggccagtccgatgccggttccctcgaactccccttcggcgtgcaggcgctggaacatcccgaagatacgctcgaaatgttcggcgccgatgcccaggccgttgtcttcgacggtgatgatccattcattgccctgacggcgagaggaaaggcggatctccggcttgcgttcgggatggcggtacttgaccgcattgccgatcaggttctggaacaggcgaatcaattcgctggaaatcccaagaatcctgggcagcgggtgttccaccaagactgtcgcctcgtcgctgctgccggtcaggccgagattggcgcaggaatcggccaccacctcctccaggtccaggtcggagagagtctcgccgccgcgccccacccgcgagtaatcgagcagccccttgatcagcgcatccatgcgccgcactccggagatggtgtagccgatgaattcgcggctggactcgtccagggtctcgcccagatgacgctccagcagggtgacgtaggaggtgaccatgcgcaggggctggcgcaggtcgtggctggccacataggcgaactgttccagctcggcgttggagcgggccagttccgcggtcttggcctgaagctccgcctcgaagcggttgcggtcggagacgtcgaccacgatgctgctgagataggcgcggccgcccacatgcaggggcgacgaatagacctcaacatcgcggatgtcgcccgatgacaggcgatgcctgaagcgcaggaacttgcgcccctcgttttccaccgccgccatttcgtgctcgatctccgccgccgaggccacgttgatgtcctggatgttcatgtgcttcaggacatcggcgggatagccgtagaacagggccgcggaatcattggcgtcggtgatggcgccgcttttagggtcgatcagcagcttgatggccggattgcggtggaagctctggctgtaaagctcctcgcgctccgaaatggcctgttgggcacggtgggaatcggtgacgtcacgccccaccgtctggtatccggtcagattatccagggcgtcgtacagcgccgtagtccgccattcgatccagagttcctggccgtcggggcggacgacccggcggcggtcctcgcggtagggctggatatgattgagggcctgcaggcaggacagggagaaggtgcgttcctcgtccggcaggaactcgatccacttccgcccgatcaggctgtccggggtctggccgtaaaagcgggcgtaggcccggttgacggtgatcagggtcgtatcctgggtatagcgatggatcaggtcatcctggtcgtcgaccaggatgcggtagctctcctcgctggccttcagggcagtctcggccccgcggcgctcgcgctcgcgccgttccagctgcagggccgcccccaggaggacggtcgagaacagcaggccgattccggccatgaccagcgtgttgacggtccagcgtcgcaacgcggcctgggtggtgatgcctaccgagaccacgatgggctggtggttcagcgcctgataggaggccagccggtcctggccgtcgaacgaactgggggcgatgaaggtgccggcccgggccttgggcagatagtcggaaaacagcgggcccgagcggatggagctgcccacatggagccccggatcgggaaggcgcgccaagacgttgccgtccatgttggcgaccaccgcccggtccacgtcgccctccacgacgccgctcagcgccccggaaaagaattccgggttgagcgcgacggcgatcaatccggcgaaggttcccaccggactggtgattggccgcgccaccaccaagccaagcttgccggtcaccgggctgaccgaggggggcgtgatgatcagatggccatgaatgggggtctgagccgccgtcatgaaataggggcggcgggacagatccaggccaagcatggatggcagcgtcgaggaggtgacttttccatcggcattgatgatgaagacgttgcggacctcgggaaggcctgcgctgcggtggcgcatcaggttcagcagttctgtaggatccgacctttcccgcgagtggatgtccacgtcctgcagcatcaggtcaaggccacgcagcgagccggagatgcgctcggccaccacgcgggtcagggcttcggtgagtcggccgctgtcattgagcgagttgttgcgatcgcgccaagccacaaggatgccactgatccacacgaccagcagcaccgcagtcaccaggaccagcggccggtaagacctgccaacgctgttcagtccatccccctgtctctacaacccctggcttaactgccctctatctcgcccgtggcggcctgaaggtagttctgcgcccccatcttggacatcaggtcgatctgggtttccagccagtcgacatgttcttcggtatcttccagaatttccgccagttcatcgcgggtgacgaagtcctgcttggtctcgcacaaggcgatggtctcgaccagcgccttgtgctcggccagctccatcctgagatccgaggccagcatctcggccacgtcctcgccgatgccaagcttgcccaggtcctggagattgggcaggccttccaggaacaagatgcgttcgatgacctcgtcggcctgcttcatctcctcgatggaatatttgtagaccgccttgcccagatccttcagcccccagttcttcagcatgcgggcgtgcaggaagtactggttgatggcggtgaggtgcagcttgagcacgccgttcaggtggcgcaggacctccttgtcacccttcatgacgcaccttgcgcgatgtcgccggccgccgattgcaggtagttctgcaggcccatgcgggcgatcaggcccaattgctgctcaagccacagggtgtgatcctgctcggtgtcctcgagaatcttgcccaggatgcgcctggtgtcgtaatcgccctcgctctcgcaatgggcgatggcttccttcaactcggccacgacctcgatttccagatccaggtcggccttcagcatggagggcacgtccttgcccacctttggcccggggcgcttggacaggtcgggggttccctccaggaacaagatgcggccgatcagcaggtcggcgtggccgatctcgtcctggcgttcatgctcgatgcgctcgtaaagcttggacaggccccattcgcggtacatgcgcgaatgcacgaaatactgatcggcggcgacaagctctccgaccaggagtttattgagccttgatatgacgctcttcttgcctttcatcggccgactcctgctcagggattgacccgacctccagcctaacatcccatcgggggatggcaaggctacgaacgggataagtccatcacgtggtgacgagttccgccttgatccagtcccggaatgcccggatgggcgggaattcggcgcgctcgggcaggcaggccagatgataggcgctggccagggggcgtccggggaacagggccaccagtcggccgccggccagttcgtcacaaaccagggtgcgccagaccagggcgacgcccagtccggccagggcggcctccaggaccagggaggcgtcgccgaagggccgcaggcgcagcgtctcggccgggctggcgcccatctcggacagccaggccggccaggtggggaaggacgggtcccagccgatgccttcattgaccagcaaggtggcgcgggcgagatcggacacctcgcccaggccggcggccagacgcggcgtcgccaccgccaccacctcttccaggcgtagccgttccaccagcagcccgggatagcgtcccggtccgtagcggatggccaggtccacgccctcgcggtccagatccaccagccgcaacgtggcggacaggtgcaggtcaatgccgggatgggcgtcctggaagcgggtgaggcgggggaccagccagcgcgccgcgaaggccggcggcgccgacaccaccagcggccgggccgggccgtcgggggccagccgtcccacggcggaggccaggcggtcgaaggcgtcgctgacctcgcccgagaccagggcggcggcccgggtcagcgacaggcgcgttccgcgatggaacaggccgacgcccaggatgtcctccaattgcttgatctgctggctgatggccgccggggtgacgcccagctcctcggcggcccgcgcgaaggacagatggcgggcggcggcctcgaaggcatgcagggcccggaggggcgggaggcgacggcgcatgattagatttccttaacccgagggcgagaaaagctcgtttgaagccaagaagttccaaagcgtatcgttgcgaccatgattagtctatctcaatggagatccatcatggggccgatcgccatctatgcccttgccgccctctcggccctgttctgggcggccaatttcaatctggccggtccgatcctggccgacatggcgcccctggcggcggcgtcggggcgcttcgtcctggcggcggtgatcatggtcgtgctggtggccgggcgcggcgaactcggcgccctgctggcggcggcgcgcaaatccggcggacggctggccctgttgggcgtggtcggcatcgccggcttcaacctgctgttcttcgacgccatgcgcaccacctcggcggtcaacggcgccctgatcatggccaccaatcccctgctcaccgccgtgctggcggcgctgttcctgggcgagcagttgcccggccgccagatcgccgccctgccggtggctctggccggggtgtccatggtcatcctgggcggtgcccgcggtgaggtggtgttcggcctgggcgacgtggaaatgatgggcgccaatctggcctgggccgtctacaacgtgctggcgcggcggttgatgccggcgggctcgcctttggtcaacgccgccattcccatggcggcgggcgccctggtgctgacggcggcggccggactgagcggggcggagttcacgctgccggggcccaaggccgcggcagcgctggcggccatgacggtgttcggctcggtgctggcctatctgttctggaacgcggccatcgcccgcatgggtgcggggcggaccgccctgttcctcaacctggtgccggtcttcgccgccagcatcgccaccctgaccggcacgccgcccaatccggcccagctggcgggcggtgccgtggtggtcgccgccgtgatattctccatgctgccccggcggccgcaaccctgcctggcctgacattgcaaccgagagattccatgaccaagcccgatctccaggacccgaccatttatcctcactgggcgcgcgagaccttgcgctattgcgacaccgacgcccagggccatatcaacaacgtggcgttctcggtgttctgcgagaccgggcgggtgcaattcctgctggagcccgggcggccgctgacgccgcccggcaccttcatggtgatcgcccggctggtgctggatttcatcggcgagattcactggccgggcgaggtgcgcattggcacgggcgttacgaagatcggccgcacctcgttccatcttggccagggggtgttcgtgggcgagcgctgcgtcgccaccgcagattccgtgctggtgctggccgatcaggacacccggcgctcgacccctctgccggacgaactgcgcgcccggctggagactcgtttgataccgacggcccgatagatcgagccgtcgtaagtccctcagtcgccgggcgcttcgctcgggcttactcggcataagccgaggcgcgcggtcgcgcttgcctccggccgatggccgtcgggagggatcagcgttcccgcctgagggtccagcgggcgccctggccggccttgttggtggcatagccgtagatcttgccgtcctcggtgcgcacgccctcgaaatcgaaggcggtctcgccgttctccacggcggtgaggcggagggtgcaggcgctgagttccgacaccttgccctcgatgacggtgccctgcttgtagcccaggttgctgttgaggtcgggcttctgctccagcttccaggtcaggccctgggcgtcgcgcttgaattcccacttggaatagggcgccacccagcggcccgccagccagtcgccggcatcggccttggtggtgtcgcaggtggcgtcgggcagcggctcgggcggcggggccttggggctcttgggcatgtcctcggccagggcgggaacactgatgagcaggcagcaaagggccagggcggcgcgacgcatggcttgggtcctcagttcttgggggcggggaaatagcccagcccgcgcatgcaggcattgagctcggcatcgtagatccgcttggcctgggcgcgctcgtagtcgcgcgtcgggctgtaggtgtcgcggccgtcgtcgcggaagccggaactccggtcggccgagcggcggcaggcggaatagtcgcggccccactggtccttgggcaattgcggattgacccaggggttgccggcggcacaggcccccagcagcagcggcagcagaacgagaatgcgatatttcacggacggaacgcctgttgatgaaacgcccggcattcggccacagcccggccgccaaggcaaggcttgaacgtctccaaagcgtcagttgagcaagcgccccccttgcgtctatactcccgccgcgctttgcgctgcgtcgcagcaacaaccataaatgtggagaccaaggatgagcggcgaatcgttgaacggaatgtatttcgaggaattgtcggtcggccagtcggccatcttcgccaagaccgtgaccgaggccgacatcgtcgccttcgccggtgtctccggcgatttcaacccggttcacatcaacgaggaattcgccagccagaccatgttcaagggccgcatcgcccacggcatgctgtcggcggcgttcgtctccaccgtgttcggcaccaagctgcccggcccgggctgcatctatgtctcgcagctgctgaagttcaaggctcccgtgcgcatcggcgacaccgtcaccgcccgcgtcgaggtcaccgcgctgaccccggaaaagaagttcgccaccttcaagaccacctgttcggtggccggcaagatcgtcatggacggtgaagccaccctgatggttccgtccaagggctgatgcctggcatccccctctccccatgggggagggggaagtcttgcgctgcgaagccttttgcactacccctttgcccttggttttttcctggggcccgatccttaaaatgcgcctgatccggcattgcggcgagctttcccccgaccaccgcggttgcgtggtggcgctgggcaatttcgacggtgtccatctcggccatcaggcggtgatcctgaccgcgcgccgcatcgcccaggacctgggcgtggcccatgcggtgatgaccttcgagccccatccgcgctcgctgttcaatcccgaccagccgccgttccgcctgacgccgttccgcgtcaagtcccgcctgatcgaggcgctgggcaccgatttcctgtatcagcagcatttcgaccgcgatttcgccgccatgacggcgctggaattcgtcggtggcgtgctggtgggctgcatgcaagccagccacgtggtggtgggctatgactacgtgttcggcaagggccgcctgggcaccggcgccttcttgcagaaatgcggcgaggaatcgggcttcggcgtcaccgtggtgccgcccgccatggccgatcacggcgagacctattcctccaccgccgtgcgcgagcatctggtggccggccgccccgatgccgccgcccgtctgctgggccattactgggaagtggagggccgggtcgagcacggcgacgcccgtggccgcctgctgggctttcccaccgccaatctgcgcctgggcgagtatcagcgtccggccagcggcgtctatgcggtccgcgccggcatcgacaagggcggggccacggtgtggcacgacggcgtcgccaatttcggccgccgccccaccttcgacaagaccgatgaattgatggaggtccatctgctggacttcaacgaggacctgtatggccgccacctgcgggtggcgctggtcgagcatatccgccccgagcgccgcttcagcgggctggccgagctgaccacccagatcaccgccgatgtggagaccggccgccgcctgctggccgcccgccatttttccgccgccgccgggcccatggtgcccgtcgcccctgccgtctgagagcccgtcatgagcgtcgattacaagaacaccgtcttcctgcccaagaccgatttccccatgaagggcgaactgcccaagctggagcccgagcttctggcccgctgggagaagatcgacctgttcggccgcctgcgcgccgcctccaagggccgggacaagttcatccttcacgacggcccgccctacgccaacggcaatctccacatcggccacgcgctcaacaagatcctcaaggacgtcatcacccggtcccagcagatgctgggcaaggacgccgattacgtccccggctgggactgccacggcctgcccatcgagtggaagatcgaggaaaagtaccgcgacgccggcaaggacaaggacgagatcgacaccgtcaccttccgcgaggaatgccgccagttcgccgccaagtggatcagtatccagaaggaggagttcaagcgcctgggcatcaccggcgactgggaccacccctacaccaccatgaccaaccacgccgaatcggtgatcgccgccgagctgggcaagttcctgctggacggctcgctgtataagggcgccaagccggtgctgtggtcggtggtggagaagaccgccctggccgaggccgaggtggagtatcacgaccacacctccatcaccatctgggtgaagttcccggtggtgacggccagcgtgcccgagatcgagggcgccaaggtggtgatctggaccaccacgcctggaccatgccgggcaaccgcgccatcgcctatggcgctgagttcgactatgtggtggtcgaggtggaaagctcggattccgatctggccaaggtcggggaaaggctggtcctgtgcgccgatctggccccccaggtggccaaggacgccaagtgcgccttcaagatcctgcacaccctgaagggcgcccaactggccgggaccatcgcccaccacccgctcaagttccacgcgaacgcggcgggcggctatgatttccccgtgccgctgctggccggcggtttcgtcaccaccgataccggcaccggcttcgtccacatcgcgccgggccacggcgaggacgactggcatctgggcaaggaacacggcatcgccattcccgacaccgtgcagcccgacggcaagtacttcccccatgtggcgatcttcgccgggatggacgtgctgaaccagggcaagaacggcaagtactactcgccggtggccaagccggtgatcgaggccatgacctcggtgggcaacctgctggcttcgggcaaggtggagcactcctatccccattcctggcgctccaaggcgccgctgatcttccgcaacacgccgcaatggttcatctccatggagagcaccgggctgcgggccaaggcgctgaaggccatcgccgagacccgcttcgtccccgaccagggccgcaaccgcatcggctccatggtggagaaccgccccgactggtgcgtgtcgcgccagcgcgcctggggcgtgcccatcacggtgttcgtggacaagaagaccggccagccgctgcgcgacgccgccgtgatggcgcgcatcgtcgcggccttcctggccgagggctcggacgcctggttcaccagcccggccgaacgcttcctggcgccggagtacaaggccgaggattacgacaaggtcaccgacattctcgacgtgtggttcgattccggctgcacccatgccttcgtgctggagggcgaggaatggccgcgcctgtcctggccggcgtcgctgtatctggaaggctcggaccagcatcgcggctggttccactcctcgctgctggaatcctgcggcacacgcggccgcgcgccctatgacgcggtgctgacccacggcttcgtcctcgacgaggacggccgcaagatgagcaagtccctgggcaatgtggtggcgccgcaggaagtggtgggcaccatgggcgccgacatcctgcgcctgtgggtggtgggctcggattattccgacgatctgcgcatcgggccggagatcctcaagacccaggtggacatctatcgccgcctgcgcaacacgctgcgctacctgctgggcgcggtggacggctttgccgcggcggaagcgctgccggtggagcagatgcccgagctggagcgctgggtgctgcatcgcctgaccgaactggacacccagttccgcgaggcctgcagcggtttccagttccacggcctgttcaccgagctgcacaatttctgcgccgtcgatctgtcggccttctacttcgacatccgcaaggacgcgctgtattgcgacgcggccacctcgcttcgtcgccgggcggcgcgcacggtgttcgacatcctgctcgacaccctgaccaagtggctggcgccgtttctgtgctttaccgccgagcaggcctggctggcgcgccatccgtccgaggacggctcggtgcatctggaactgttcccccagattccggcggcgtggcgcgacgacgccctggccgccaaatgggccaggatccgcgacgtgcgcaaggtggtcaccggcgccctggagatcgagcggcgggaaaagcgcatcggctccagcttgcaggccagcccgcgcctcaccgtgtcctcggagatccacgaactgctgaccggcctggacatggccgagatctgcatcacctcggggatccgcatcatggacgggctgcctgtcgagggcgagttccagcttgccgaggtgcccggcgtgtcggtggccccggccccggccgagggcgaaaagtgccagcgctgctggaaggtgctgcatgacgtgggacgcgccgggcatgagggtgtttgcccgcgctgctccgacgccgtcggggcggtgtagggcgatgctgctgtccaattccctgccccgcgggctgtccatcgccggcctgatcatttttctcgaccagctctccaagtactgggtggtcgagaggatcatgcgccccgagggcgtcgacggaaccccgttctactccgccacccgcatcgagctgctgccgttcttcgacgtggtgatggcctggaaccgcggcgtcagcttcggcatcggcaataacggcggcgagtggaacgcgctgatcctctcggccctggccatggtgatctgtgccggcatgaccttctggctggccaaggccgagaccttcctggtccaggtcgctctgggcggaatcatcggcggcgcgctgggcaatgtcatcgaccgcgcccgtttcggggcggtggccgacttcctggacctgcatgtggcggggtatcactggcccgccttcaacgtggcggactcggccattacggtcggcgctgtttttctcgtcgtcgactccttgtttgccggccgcgattcgtctaagaattagggccatgaagaccgatcgccccaccgtccgcctgtccaccgcccgcctgatggctttggccactctgctggcgccggtggtgttgtccgcctgcaccgacgtcaagcgctcgcttggctatgaaaagcagccgccggacgagttccaggtggtgcagcgcgcccctctggccatgccgccggaattctcgctgcgtccgccgcagcccggcgccgtccggccccaggaaggcgtgacccgcgatcaggcccgtcagattctggtgggggggcgcaccgccactcccatttccaccgaggggcgcaccgccggcgacatctccctgatgaagcggatcggcgccgattccatccagccggagatccgcgtgctggtgaacaaggaatcccaggccctggccgatgcggacaagagcttccaggaccgcatcatgttctggcgcaaggcggagccgccgggtgccgccgtggatgcctccaaggagacacagcgtctgcgcgagaatcaggcgctgggcaagtccctctccgatggcgagacccctcaggtccagcgtcgcaagcgcgcctggcttgaaggtatcttcaactaatctggctttgccttgatcccgccatgatgtgcgcgcagccttcggctgcgtgtcgcgatgactcttgtctggaggtaggatgaccgccccccgtctgtgcgccgtattgctcggcctgtttgccgtcctggcatctcccgtccgggccggagtgttcgacccggcgaccttcaccctggccaacggcatgcaggtggtggtgatctccaaccaccgggtgcccatcgtcagccacatggtctggtacaaggtgggggccgcggacgaggagccgggcaagagcggtctggcccatctgctggaacacctgatgttcaagggcacgcccagcgttccccccggcgagttctccaagatcgtggcgcgcaacggcggccgcgacaacgccttcacctcgtcggactacaccggctattaccagaacgtggcggtggacaagctggaactggtgatgcgcatggaggccgaccgcatgcgcaatctggtgctggacgaggccaatttccgcaccgagcgggacgtggtgctggaagagcgccgctcgcgcaccgacaacaatccgtccgccctgctgaacgaacagatggaagcggcgctgtatctcaactcgccctatcatcgccccatcatcggctggcccgacgagatcgccgccctgaccctggacgacgccctggccttctatcgccgctggtacgcgcccaacaacgccatcctggtggtggccggcgacgtgacgcctgatcaggtgcgtcccctggccgagaagtattacggcaccatcgcccgcgccgacacgccgccgcgcgcccgcacggccgagccgccccaccgggccgagcgccgcgtcaccctgaaggacggacgggtggcccagccctcctggagccggctctacctcgcccccagcctgggcgagggggcgcgggagctggcctatcccctggaggtcctggccgacctgatgggcgagggcgccacctcgcggctgtaccgcagtctggtggtggagaagggcgtcgccgccgccatcagcgcctcctacgatccggtcgctgtggggcagaccactttccggctggcggccatgcccaatcccggcattgccttggacaagctggaggccgtgatcgagcaggagctggcccgcatcgtcaaggacggcttctcggccgaggaggtggagcgcgccaagacccggttgcgggccggtgccgcctatggccgtgattcgctgcataccggagcccagaccctgggccaggccctggcctcgggcgtttccgtcgaggaggtggaggcctggcccgaacacatcatggcggtgacgcccgagcaggtggccaaggccgccgccgctttgttcaagcccaccgcctcggtgaccggcctgctgctgcccgatccctccgccgggccggcggtccgccgcgccgtgatgcccctgccgggctccgccaccaagggagtgcactgacatgccgacagccattgtcatcccgagcgtaagcgagggatctccgctcggcacgatgacgtcggatcggaacagccgttccagactgggattcctcctcccgaaggtcgtcggaatgacagcccggattgtcggatttgccgccctgctgctggccagtcttcccgccggggccgtcaccgtggaaaaggtgaccagcgccaagggcatcgaagcctggctggtccaggaccatgccaaccccatcatcgccatggaaatcgccttcaagggcggggccgcccacgacccggccgccaaatcggggctggccggcatgatggccgccctgctggacgagggcgccggtccccatgattcccaggccttccagcagattctcgaggacaaggtcatcacgctgggcttcaacgccgggcgcgacagcttcgccgggcacctcaagaccctgtcggagaacagggacaccgccttcgagctgttccgcctgtcgcttgtccagccgcgcttcgacaaggagccggtggagcgcatccgcggccaattgctggccggattgatgcgcgaaagccaggattccggcgcccaggcctcccgcgccctgttcgaggcggctttcgccggccacgcctatgcccgctcgccgcgcggcaccgtcgaaacggtcaagaccatccaggtggccgacttgcgggccttcgccaaggggcaactgacccgcgaccggctggtggtgggcgtggtgggcgacatcacgccgcaggaactggcgcggcgcctggacgaggtgttcggcgccctgccggccaccggcccgctgggagacattcccgaggtggtggcccatctcccggccgggctggtggtgattcccaaggacaatccccagaccaccgccctgttcgccctgccgggcctgcgccgcgacgatcccgactggtacgccgcctatgtggtgaactacatcctgggcggcggcggcttttcgtcgcgcctgaccgaggaggtgcgggaaaagcgcggcctggcctattccgtcacctcctatctgtcgccctatgctcattcgggactgatcgtcggctcggtggccaccgagaactcgcgcttcgccgaatcggtccgtctgatcaaggaggagttccgccgcatgcgcgacgaggggccaagcgagacggaactggccgacgccaagacctatctcaacggctcgttcccgctgtcgcaggattccaccaccgccatcgccactctgctggtgcagatgcaggtggaccggctgggcatcgacttcctcgaccggcgggcttcggtgatcggggcggtgagcctgggcgacgcgcgccgcgccgccaagcggttgcttgacgccgacgccctgtccttcgtggcggtgggaaagccggcccggtaggggaagaaagggaagcgggcgtgatgcccgcttcgccctatttcttcttggtcagctggtcgatctgcttttgcagggccgagacgctggcctgcagatcctcgaccttgggcgaggagccgtcggcgccctggggatagaagggcgagaacatcttcatggcgctttccatgaaggccatgttcttcttgcccatctcctcgaacgggccgaaggggaacatcccttccaaggcgttgcgcatatagtcgcgcatctgcgcctcgttatgggagaaggcctgcatggaatattccaggtagcgcggcaccagcccgcccagggaatcgccgtaaaagccaatcagctggcgcaggaagctgatgggcagcaggttctggccgcccttggactcttcctcgacgatgatctgggtcagaaccgagcgggtgatatcctcgcccgtcttggcgtcgtagaccacgaaatcgtcgccatccttcaccatctgtgacagatggtccagggtgacgtagctgctggtcgccgtgttgtacaggcggcggttggcatacttcttgatcgtgatcggggccttggcggaggtctgggactctgacatctgctgtttgtctcgattctatccggagggcggcattgcccgctgcattgcaccaatagtaacagaattttacgtggcgcgtcgattggcaacaattttcttgcgccgccatgaaatcgcccccacccgtatggtcaaggaagggaggctgggctatgatccggccatgtccgatgcgccccctgatttcaaggcgctcgcgcgccgctatctcgacctgtggcaggagcaggtggcggccgtggccgccgaccccgccctcgccgaggctgtcgcccgcggcgtcgccatgatgacgcaaagtgccgccgcggtggcccaggccaccgggctgaaggtgaaccaacccgatggtggaccgaaagcggaaaacacgtcccagcagcccggcggtccggacggggccgcgtcccctggcgctgcacctcatgacccacgcctcgaccctgacgagctcgcgcgccgcgttaccgcacttgaaggacggatcgctcggctggaagccgcccttggcggaggcggggcggaccctggcgcaaagcctcgacgcggccggacccgacgcttggactcggcttgacgaggccatcgccgccgaggccgtccgccgtcacgacgcctttctcgacggcatagaggcctatcgccaccatccctatcggcgggatctgccgccggcccccgaggcctggcgccagggcaccacctcgctgcgggattaccgccagcccgaaagcgacgatgcccgcccggtgctggtgatcccctcgctgatcaaccgcgcctatatcctcgacctcagcgaaaagcgcagcctgatgcgctatctcgccgccaagggattggcgccgttcctggtggattgggatgcgccgggcgaggcggagaagagcttcaccctgaccgattacatcgccggacggctggaggcggcgctggacgaggtggtgcgcctgaccgggcatcggccggcggtggtgggctattgcatgggcgggctgttggccctggccctggcccagcgccgccccgacgcggtctcggcgctggtgctgctggccacgccttacgacttcgtcaccgggcgcgaggccaacgccgtcctgatgaaggccctggcccagcccatgggcgggctgatcgacggggtgggggaggtgccggtggacatgctccaggccatgttcgccgggctggaccccggcctcgccgcccgcaagttcatggcttttgcccgcttgaagcgcagaagcgcccgggcgcgggacttcgtcgccctggaggattgggccaatgacggtgttccgctggccgggccggtggcgcgggaatgcctgttcggctggtatggggaaaatgatcccgtcgaggggcgctggtgtatcgaaggcaggcctgtcaaccccggcgaggttacagttcccaccctggtcatgatccctcagcgcgacaggattgtgccgcccgtatccgctttaccattgtgggaacgcatcccaagtgccaagctgatgaggctgtccggcgggcatgtgggcatgctgaccggaccgcgcgccaagaccgaggtttatggcccgctcatgcgttggctgcaccgcagggcaggcacttagaacggttgcagaaggggtaagcgaagcgttatgacatctgggggagacatctttctggaacaacgccagaaagtgcgccttccccacgtggtcccgccccttgcggccttataaccacccgaggagacaacaagctcatgaccgacatcgttatcgccgccgccacccgcactcccgtcggctcgttcaacggctcgctggccgggttgcaggcggcccagctgggcgagatcgtcatccgcgaggcgctgaagcgcgccggggtggaggccgaggccgttgacgaggtgctgctgggtcacattctgaccgccggctgtggccagaacaccgcccgtcaggccgccatcaaggccggcgtgcccaacaccgccaccgccatggccatcaaccagctgtgcggctcgggcctgcgcgccgtggccctgggcttccaggccatcaagctgggcgacgccaatatcatcgtcgccggcggccaggaaagcatgagcaacgcccagcacgccatctacatgcgtggcggcgtcaagatgggcgacgccagtctggtcgataccatgatcaaggacggcctgaccgacgctttcagcccgatccatatgggcatcaccgccgagaacctggccgagaagttccagatcacgcgcgaggagcaggacgccttcgccctgggctctcagaacaaggccgaagccgcctccaaggccggtcgcttcaaggatcagatcgtgccggtgaccatcaccgtcaagcgcgaggagaagctgttcgacaccgacgagttcatccgcatgggctgcaccctggaccagatcgccaagcccaagcccgccttcaagaaggacggcacggtgaccgccgccaacgcctcgggcatcaatgacggcggcgccgccctggtgctgatgaccgccaaggaagccgacaagcgcggcatcaagccgctggcccgtatcgccggctgggccaccgccggcaccgatcccaacaccatgggctacggcccggtccccgccacccagaagctgctggccaagctgggctggaagcacgaggacctcgacctgatcgaagccaacgaggctttcgccgcccaggctatcgccgtcaacaagggcatgggctgggatacctccaaggttaatgtcaacggcggcgccatcgccatcggccaccccatcggcgcctcgggcgcccgtatcctggtcgacctgctgtacgaaatgggccgccgcgacgccaagaagggccttgccaccctgtgcatcggcggcggcatgggcatcgccctttgcgtcgagcgttgatctagtcaggttctttagaaaaggggagccgcgcccgcccggcggctcccccgttttttcccagggtgggaatacagatcggacagccggagcataccggcatcaaagatccgagcggagacacagtgatagaggagaagtccatgggtcgtttagcaattgtgaccggcggcacccgcggcattggccgcgagatttcggtgaccctgaagaaggccggctacaaggtggtggccaattacggcggaaatgacgaggccgcggccaagttcaccgccgagaccggcatcccgtccatgaagtgggacgtcggcagctaccccgcctgcgaagccgccatcgccaagatcgtcgccgagcacggccccgtcgagatcatcgtcaacaatgccggcatcacccgtgacgccaccctgcatcgcatgagctaccagatgtgggaagaggtcattcacaccaacctgacctcctgcttcaacatggcgcgtctggccatcgattccatgcgtgagcgcggcttcggccgcatcgtcaacatcggctccatcaacggtcaggccggtcagtacggccaggtcaactatgccgccgccaagtcgggcatccacggcttcaccaaggccctggcccaggaaggcgccgccaagaacatcaccgtcaacgccatcgcgccgggctatgtggataccgacatggtccgtgccgtgccgccggcggtgctggaaaagatcatcgccaagatcccggtgggccgtctgggccgcgccgaggacatcgcgcgctgcgtcatgttcctgatcgccgacgaagccgatttcatcaccggctcgaccctgtcggtcaatggcggccagcacatgtactgatccggttttccggttcggctctaatgggaaagccctcgtcctttgggacgggggctttctttttgacgcaatttccgtcgtggcgccaatccacgggtggaatttggttcgccttcctcactctgcgcatattgcgtattgctacggcctaccacatactgaaggcgtgggctttggtgatgtgaggcatagtaatggcggtttcctgccgtggggcgagggctcatcctttatgtgcagccgtcgcttgccgggaaggtgccctgtgattcttggggcggctcccaatccccatatggccgatcattcgcgcaagatcctggtggcggtggtcgacgcccatgcggggcatcgcaaccaggtggcctccgccctgatgtcgttctatcaggtggcggccttcgacaacttcgatcaggccatggaagccctggtcaggacgccgccctgcgtggtgctgctggacgagcggatcgtgccgcgtgccggcggcgaccccatcgcgctgacccgccagctgctgaggggggtgcctatcatccgcaccctggcgcggcacccgtcgcaattgggcagcgccctgtatgataccgatgcctgtctggaaaagccctatcgccgttcgacgctgatcaagaccatttccagcctggtcaacaagacggttgaggcggaatgggagaccttggcgccgcaataccgcgagtcgctgcgtcggaccgtggacagcttcaacaacatctcggacctcatcgacaagggcgagcccctggtctacaccgagatcaccgaggcctgcggccccctggtggatgcggtcagcaaccacgatttcaaggtgatcctcaacggggtcaagggccatgacaactactcctacgtccactcgctgcgggtggcgacgctgctgtcgctgttcggccacaccatcgggctgaagggcgaggatctcaacctgctggccagcggcgggctgctgcacgacatcggcaagatgaccatcccccacgaggtgctgaacaagcccggccggctggacgacgtggaactgcaggtcatgcgtagccatgtgagcaaatccgtggattatctcaagctgtgcgaccatctgcccaagggcgtgctgaccatcgccgcccagcaccacgaaaagctcgacggcaagggctacccccacggccttcacggctcgcagctcaacgagctggcgcgcatggcttccatcgtcgatatcttcggggcgctgaccgatcgccgggtctacaaggagcccatgtcccccgaggacgctctgaccctgatgaccgagcgcatgggcggcgagatcgaccagtcgctgctggccctgttccgcgccatgctgctggacgcggccactcccacggcgtgacccgcggcgttctcagaagctgacggtggcctgaacgaaggcactgcgccccggcgcccattgcagcttggtcgtggggctttgcggcagcgggttgacgtgcaggtgatagtgcttgtcaagcacgttggcgatgccggcggtgagggcggcgcgttcccccagtgcgacgccggcgaacaggtcaagcagcgcccagccggcggtgccgcccgccgtgtcctcggccgatcccgtggaggaataggcgtcgattcggttctggctggcggcgaagctgaggcgtgcgcccgccgatcccacggtgtcgggggccagttcgcgccggtgctcgatcaccatctcaccgtccagcggcgggatctggtagagagggcgcgaatcggtcaggttctcgccgcgtgtccacgacagcttggctcgcgccccccagccctccgagacctgccaccaggcttccagggcggttcccgccagataggcgtccacattgcggtagatgatggcgccgtcgcttctggcgatgccggtctggcccctggcccggtcggcggtgatgaaatccaccacgcggtcgccatagcccgagaccgccacccgccacgaccccgtcggattgcccggcgcgaaattgcccttgaagccgccgccgtcctgacgcgctcccagctcgaagcgatgatgggcctcgggattcagttgcgggttgcccacctgggtgagggcggtggggccggaattggcatagaagcgctcgcccgcatccgggctgcgcacggcccggcgcagatcggcatgcaggcgcccggtacggtcctcggtgtcgtgggccaccagaatccggccgctgacattgagattggtcgggttggaatcgacgttgccgccgtaatagcggttccacaattgctgtggcgtaacctggaacgacgaggcccccgagccggagaccggtggcaattggctgcgctcgttggggtccgagtggatggcgtccaggcgcagggcggcgctgagggaatcctgcggcgacagcttggtggcggtggcgaaggtcagcccgccttgcagcgtttggacatcgggcatgcgatggacggcctgcccctgggcggggtaaagggcatcgatgtcaatgttgtacttcaacaggccgaaatccgccgtcaccgtattgcggaacgagccggtggcgaactcgccgcgcaccagcccgcgcgcggtggtccacaggccgttgtatttgaggcccaggctgccccggtccctcagggaggtgttgtcggcatcgtagctcagcgcatcgaataccagtccggcctcaacccggttcagcgccgagtcggtcggcgcgtgctcgaacaccgtcgaggcgaggtagcggtccagccgggtagcgtcgatgccgtaattggggatgcggtggtgggagaaggcgtcgcgcatgacgaagccggacaggcggcttttgggcgcggggcgccaggcggcggccaattgggtgttgatgcggtcgtagccgtaattcacccgctgtccggcaccgtcttcatagggcttgacgtggtcgtgccgcgcaccggcccagagggatgcgtcccccagctcggtattggccagtcccgcctcggtggacaccacgccgttgccctggaagccgccggtaagtgcaacattgcccgccgccgccacggcgcggcgttgggcgaagaactcggtgggccaagcggtcttggccggcatcagcggctcggccaccggcaggtcggtcagcgggatggtcggcggcaggtcctggccggcgtgccgccccatatagcgggtgtcgatgaacgactgatcgggcagcagcttgggcggttcggccgcgggggcggattcggcaagcgcccccatggccaccagcaccggcagaccgcgcagcaaaatctgtcttggatgacgcccccgtctcatgctttctagaactaatgggattggacacccaaaggcaagtcaatccggttgcaacctttgcgctcaggtttgcttcggtgcaccggttcgaggcgctgtgacagggaggggaaggccttgggtttgtgggggcggatgcggttcgcggcggtcctggcaatcattctttgggcagggctggcatccggccccgcggccgttgccgccacgccgttgtctcccgagaccacggagcagtccctggcgggccattggtcggtcctgcgcgatccttccgggcaactcgagatcaaggacgtgatcggtgcggcggcgggcggcttttctccgctcgagggggatctcgccgccggctatgaccgggcgtcctggtggatgcgcgccgagatcaggcgaagcgccgatacgcctgccgactggctgctggaggtcgaaccggcctatctggacttcgtcaccttgtacatcgaggacggcaagggcgggtttcacgtggccatggccggcgaccgggtgccgttcaccgcgcgggaggtggcctatcgcacgctggtcttccgcctccatctggccgacgacttgccccacagggtctatctgaaggtcaagtccaccagcaccattaccgtctcggcgcgccttctgtcgcccgccggattcgccctcggcgccgctcgccgcgatctcgcccagggcttcgcccatggcgtgctgatcatcatcatcttgttcgccgtggttcagtattcggcggggcgggaccgcctgtatctgtcctttctcgcctgcgccgtcccgctggaatgcatgcatttggcccggggaggctttgcctcccagtatctttttccccaattgcccctggtcgccgaccatctgctgggggtctcgctctgcctgagcatcggcggagcggtgatcttcgccgcccgcgtcctggatctcgaggtctattttccccggttggaacgcatatacatgatgatcgggcgaagctgccagtgggccgccctgtcggtccccgccggaatctactggctggtggctcccatggtggtgtccacggtcatcgccttttttgccgtcacctccattctggccgtgcgccgggtgatggatggcgatgtcttcacccggtggtatctgttcgccgtgcagatcccggtcatggccaatgtcgccatcgtgagccggacgctgggctttgcccccatgcccatggagctggatctgttcgcccatctcggggcgggcgtccatctgctgctgatcgggtccggcctggtgtggcgcggcgccgccatcgaggccagccgccagcgggccaggcaggcgcaactggaatcggcgcagcagatcgagcgggctttggaagagcgggtgcggcagcgcactcaggaactggcccaatccaatgccgccctggccaccgagatcgccgagcggcgggccgccgaggatcgggtcagggagcgcgagggccaattgcgcgccatcctcgacgcggcgccgtttcccatggtggtggccagcttccccgagggaagggtcatgttcctaaacgagccggcctgcgaactgttgaatgtgagtcaggacagggcgatcgggcagcaggccagcgacttttactccgatgcggacgagcggcggaccctgatcgaccaactgggcctgagcggtgccgtcctcggcgtcgaaatgcgggtgcggcgcatgcccggggtggagcgctgggtgctgctgtcggcggtgcgcttcgtctataacggccaggattccaccctggtctgtctgaacgacatcaccacccgcaaggatctggagaacatgctccggctgagcgggcgccgggccgaggcggcgttggaggcggagcgccaggccatgcgcgagcagcgcaacttcctggccatggtttctcacgaattcagggtgccgctggccatcatcgaggcggcgtcgcaattgctgggcatctatctgcgcgccaacgacgacgccagggacgaggtatccaagatccgtcgcgccgtgcgccggatgtcggaactgattgatgtctgcctggccgacgaccgcctggattcctcggccatgcggctgcagctcgaccgggtggacgtggcccgcatgctgagcgacatctgcgacgacaagcggcccttcgccgggtaccgggacctgatcatccaggctccccaacgggccatggccatggtcgatccgactctcctgcgcatcgcgttttccaatctgatcgacaatgcgctgaaattttcgccggccgacagtccggtgaccatccttgtgaccgccgattccgacgcggtccgggtccgggtctgtgaccagggtccgggaatcgccttggacgagcagccgcgcatcttcgaaaagttctaccgctcgaccaaatccgaccgcgtccgcggcgccggtctgggtctttacatcgtcaaacgcatcatggaccttcatggcgcggcgatatcggtggacagccagggcggcgcaggcacaatattcgacgtatggttgccggatggggtcggcgaacaaccaaacgagctaatacttacgcgctagatgagaactttgtaaagtatggtgaaattgaagccaagattgtctcgttccgggggggttctatgatcaaggtaatggtcgtcgaggacgatcctgatctttgtggctctatttgccgctatctttccctggtcggcatgaatgtccagcgggccgggtcgggggcggagatggatgccctgttgccggatttttcccctgatctcctggtgctcgacgtcaacctgcccggcgaggacggcttttccattgccgcccggctgcgttcggccagcaaggtcggcatcatcatgctgacggcgcggggccagctggatgaccgggtgctggggctgaccgccggggccgatgcctatctggtcaagccggtgcagttccgcgaactggaggcggtgattcacagcctgacccggcgtctgagcgaaccgccggccgaggaaaagcgcgaaacccgcgaagacggcaaccagacctggggcttcgatgccgccagctggtcgctgatcacccccaacggccaccgggtgccgctgaccaacgccgagtaccgggtgctgcagaccctgacccaggagccgggcgcctcggtggcgcgcgacgacatcgcagccgcgctgggcaagagcgtcggcggctatgacgaccgtagcatcgacgcggtgatggcccggctgcggcgcaaggtcaatgccgccaccggcgagaatttgccggtgcgcgccgtgcgctcggtgggctacgtcttcgccgcgcccgtcgaggcccgcgcccggcaagccggatagaccatggcccgcaccatcggctcccacggcccgcgcaccatggaggccatccgcaaggcggggctcaagctgatctacgagcatggcttcgaggccatgagcctgcgccagctggcggccgaggtcggcatccaggtgggctcgctctacaatcacatcagcaccaaggaagacctgctctacgatctgatccgcacccatatggacgagctgttcctgcagttcgacgcggccatggcggcggtggacgggcaggggccggaagagcgtctgcgggctttcgtggccttccacgtcacctatcacatcgtgcgcaagcgcgaggtattcatcggggcctcggagttgcggagcctggagcccaatcactacgaggatatcgtgtctcttcgccggcgctacgagcgccgcctgatcgacattctcgaccagggcgaggcggccgggctgtttcgctgcggcgacgcccatgtggccgcctatggcatcctcagcatgctgaccggggtctgcacctggttccgaccccatggccgcctgaccaaggagcaggtgatcgccatgtattccgaccaggtgctgggcggattgatgggtccccgtggcccgtgacattctgatccgtggcaccggcgagatcgcctcggccatcgcctgccatctgacctgggccggatgccgggtggcgctgcaatcgtcgcggccgcccatcgccatccgccgccggatggctttttccgacgcctacttccagggaaccgccgaactggaggggctttgcgcccggcgccttggggatgcccggtccatgggcctcgcctgggacgcgggggaggttccgttgctggccatggagttccaggcggctcttggcgctcggccctgggcggtgctggtggacgcccgcatgaacaagcagcaggcccccgagccccagatcggactggcgcccctggtgatcggcatggggccgggctgcgccatcggcgtcaacgtcgacgtggcggtggagacctcgtgggaccaactgggccaggtggtgcgccgtggctccaccctgatgctggcgggagagccacgcgccgtgctgggtcaggcccgctcgcgcttccgttatgctccggtggcggggatcttgcgctccgaggccgccatcggccagcgggtgagggagggccaggtggtcgcccgcatcggcgatgcggtggtgcgagccctgttcgacggtatcgtgcgcggcctgacccatgacggtgtgccggtggaaaaaggcaacaagatcgccgagatcgatccccggcccggcgaggtcaagctggccggcatcgatgaacgtccgcgccgcctcgccgaggcggtgacgtccatcgtgctggggtaagattcacgtttgcccctcgccgggcgcggccttccggccgcttgagcaatctgcgtcagataacgcaggttgctctaaatcctcgcctcagggaatggcgtaggtggcggtcacatgggccaccagttcgtccgttcccgccgcgatcagctcgaccgcgcccatggccaggcggcggcccagcttcagcaggctggcctcggcgatgatgtcgcagcgctcggccttgcgcaggaagctgatgttgagattgctggtcaccgccatttcctgctggccgatggccgacagcacggcggcgtaaagcgccacgtcggccagggtcatcagggccgggccacagaccacgtccaccggccgggtcaggtgggggccgaagggcatcagcagccgcgccgtgcccttgccgatgctctcggcccggatggccagatcgcgggccataggcagcttttccatcagcagggcgttgaactgttcggcggtgatggcggacattgggcctcctggttaaactggtccgaccagtgtccgggatttccgccggtgatggcaagggaggtttggtatgtccgagctcgaaaccattctgctccgccgcgacgaggcgggtgtcgccaccctgaccctcaaccggccggaggcccgcaacgccctgtcggtggcgctgatgtccgagctggactcggaactggctcgcatcgcccgcgatcccgcggtgcgggtggtggtgctggccgccaacggcccggccttctgcgccggacatgacctcaaggaaatgcgcgcgctgcaagggcgcgatgaggtggcggcggtgttcgccctgtgctcgagggtgatgaccgccatcgtccggctgccccagccggtgatcgccaaggtccacgccatggccacggcggccggctgccaactggtggccagttgcgacctggcctatgccgcgaccgaggccaagttcgccaccccgggggtcaatatcggcctgttctgctcgacccccatggtggccctgtcccggggtgtgggccgcaagcaggccatggagatgctgctgtcgggccgtcccatcaacgccgggaccgccgagcgctgggggctggtcaaccacgtggtggccgccgaggccctggattccgaggtggcgtccatggcccgcctgatcgcgtccaaatccgcccataccctcaaggtgggcaaggaggccttctatcgtcagctggagatgggcctggacgacgcctacgccctggcatccaaggtgatgaccgagaatatgctggccatggacgcggcggaaggaatcgacgcctttctggagaagcgcccgcccgtatggcgtggctgctgagcgagccgggcctacctgaactcgaacagagtttggaaggctgcgcgttccatggcttcgcgcgctggtcccttggctccatggatcaccaccttggttccggccgcgttggcgctgtcgtagatgtggacgaacaggctcatgccggtggaatcgacgaagtccagttcaccgagccggatatcccaatgccccttttccttcttgtccagttcggcaagaaacttggggaagacgtcggcagcggcgaaggtcagccgtcccttgatggtgatgtcggcgcccccgctgaccgtcttgatgctgtattccatgatctgatgccttcacgctggagcgtcccgcaggtcggtcttccgaccggccgggctccattatgccctaggatgtgcggatggatgtgaggaaagaatcgacccggtcacgcagccggttggcgcgctccgagacgtcctgggcggtctgcagcacttcggccgaggcctgtcgcgtttcctcggcggcatgattgacgccggcgacattggcgctgatctcgccggtggcggtggccacctgggttacattggcggcgatctcgccggtggcgctgtcctggccttgcaccgcctgggcgatgccggtggctacgtcgtggacctgctcgatcaccgaggtgatggcggtgatggccgagaccgcctcgccggtgaccttctgcaccgtggaaatctgtcccgcgatctcgtcggtggccttggcggtctggttggccagatgcttgacctcgttggcgaccacggcaaagcccttgccggcatcaccggccctggccgcctcgatggtggcgttcagtgccagcaggttggtctgggcggctatgtcgttgatcagggccaccacggcgccgatcttgtccaccgccgatgccaggccgtcgatcagctgggtggtgcgccgcgcctcggccgaggcctcctcgctgatgcgcacggaatcctggaccttgcgggtgatgtccttgccggtgtgggccagttgctccgccgagccggcggcggtgcgcatgttgacggcggtttcctcgatgccggcggccacggccgaggcctgggccgaggcgccttcggcggtcgacgacagggagcgtgaggtggcttccagctcggtggcggtggacgccatgcccgacaaggcgtcgcccacctcgtcattgaactcgcgcagcaggttgtcgatgacccgggcgcgccggtccttggccacttccgtctggtggcgctcctgctccagccggtcggcgcggatcaggccgtccttgaagatctccacggcgcgggccatggcgccgatctcgtcccggcgctccagtccctcgatgagtacggtcttgtcgccctcggccagtcgggtcatgtcgaaggtcattgcggccaggggccgggtgatgccgcgggcgatgaccgaaatcaggatgatgcccagcgtcaggacggcaagggtaatccccagagaggcataaagggcgctcagggtggcgtcatggcccttgtcggccatgtccaccagggccgccgaggccatgtcctctacctgcttcagcaggtcgatcttgcgggtgatggtgtcgaaccacaccggagcctcgatgccgcccagatcgttggtgaacggggcatccagcgccacggcgcgcatgcggtccacctccttgacggcgggatcggtctgaatcttctcgaaggcctgacgcagctcgggctcggcgttcttggcgaaggtgtcgaagaacacctcctggcgggcgatcagttgggtgaaactgcgatggagcgccggagcaaaggccttggcggcgaagccaccgctggcggtggcgcgctcctgtccggcccgttccttgccctgcagcaattgcacataggcgatgatcgccttggtgacgcgggtgtcgcggctgaccaccgccatctcctcgatcaccgccagcagccgggcgatggttccggtgtaatagccggtggtgtcggccaaggggaggctgagggcggtgatggccatccgcttgtcgtccagtcccttcagggcgatctcggcggcgtccagcttggccttgaagctggtgccgtaatcggcggcggggaagtgcgacaaggccgtcctcagtccggaaagctggccgtcggtggccttgcgctgctccggcaggcggtccttgaacttctcgcccttgctgccgacgaagccggccgaggtgccgcgctccttctgcagttcgtggaccagggcgctgaccgccggggccaggcgcgccagttcctccacctgctccatctcgttggcctgccggcttttttccgagagggccaggccggaatagacgatgactgccaccagcggaatgatcagcgccagggcaagccggactgcgatcctgagatttttcagcatgggagcctcttcggcggatggggcaatgcccgcgagccgcgtcatacctgcaattcgacgatgtggagaccccttaaattcaggcctcaacgatgcatgatatatcgaaggattgtggtcgccaaactattaatattgacgaaagtgaagggcggcaatgctgtaagtattagcccttacagcccggtctattccacgacgatatcgtgaatatattccagggtctcgccgttttcgtcgaaccagttcagtttgatcttgccgctggtggtggcgacggcgaaaaagctggcgaagggattggccgaaaccgcctggtgccagtcggcgctgatcaccggctggttgttccaggtgcaggtgaagcgggtgatgatgtgccggggaatggtcttgccggccgcgtccttgcgcaggccggtctccatgtcgtggctgacctgggtcttgatctcgatgatctcgcccttcttggccttggccgggatgcgcaccttgacgcgatcggaattcgccatgtcctcagcctccgcagccgccgatggtgacggtgatttcctggcgggcgatccagacctcgccgtcggaggtcaccgcataggcccgcaccgtctgggtcttggccaggcgcatgcggaagctgacctcggcgcggcccgactggggggtcaggtaccaggacgacaccaccggatagggattggcctcggccagcacatggatggccttgacgtggtcggcggcggtcatgggcgagtccaccgaaacggtgatgggctccgaggcgccgctggcggccacgtcgcgcatcttcagcttgaccttgccgtccttggccttgaagggccccatcagcttgcgggccagttcgtcggcttcctgcgccagtgcgggcgcggccagacccgccgtggcggccagcgcggcacttgccgccagcacggtccggcgattcagattccgggatgcgtccacgtccctctcctccccaggaatgttttttctttcatggtagcggaggcgggcgagacggcgcaaccgatatatcataatattatgatattcagcgggacagaaaggaccggaggccaccgcgcagaccgccttcgtccaggctgcgcaggccaatgacgccgcccaggatgatcgaggccagggccaggaacgaggtggccgacaaggtcgacagaccggtcagtccttggccgatggtgcagcccatggccatgatgccgccgatgcccatcagcgcggcaccacccagatggcggagcaggtcggcggtatcggcgaagccttccagggcgaagctgccccccaggcgggccgccaggaacgagccggcgacgatgccgcctaccgccgccacgccgaagctgatggtcgcgccggtataggtcatcaggtacatcagtccgtcgcccatgggcgagatgaacgacagcgaggtcagttgcaccgggtcgaaatcgtcggcgcccaggatgccggtgacggcccagccggcgggaacggtcaggccgatcaccagggcgccggccagcgtactccccgccgtccggaaggcggcatccttgagacaccagatcagggcgccaccggccagaacggcgacggcaagagggcggccgacggcttcggggaggccccatccggccagcagggccggcaggctctggccgctggcgcccagccgggtcgcggcgatattggtcgcctgttccagggcgatgcgctccatggccagcaggcccttcagggtcatggtggcgaacaggccggtcaccagcaccaccaccagggatttgagattgccgccgcccagccgcaccagggtcttgctgccgcaaccgcccgccagggtcatgccatagccgaacatcagcccgcccaggatggccccggcccaggggagggaggcgcccagatagatggacttgtccagattgatccatccgcccgcctgcaaggcctgcgatcccagcagggccaccgccatggccagaacccaggcccgcagccgccgccggtcgcccaggaacaccatgtcggacagggctcccatggtgcagaagtcgctggcccgcgccgcccagccgaacactgcgcccacggcgaaaccggccgagccgacgagggtggtaagggcgatctcggacaaggggctgtctccgccaagtctgatggggttcatccaggctatcaccggcaaggcgatggcatcaatggactgggatatgggctaatattagtgtagcctcatatcaacagggcgagccagcccgctgagacgacataagggaggaccagggatgtcgaataccgttctggacgtgaagggcctcaattgcccgctgcccattctgcgcgccaagaaggccatcaaggacctgacggcgggggcggtgctggaagtgatcgccaccgatcccggctcggtcgccgatttcgacgccttctgccgccagaccggtaacaccctgctcagccaggagcaggaggccggcgtctataccttcaagatccagaagggcgcctaacgcacgatcctgagcagcgagcgcaggcggccgacgctttcctcgtcgaccagcccgtccaccttccagggccggaaatggcgctggaaggcggtcagcgtcgccttgggatcgtggatgtcgtaacccacatgggccaggcccgacagcagcacgtgctcgggcggcagcggcgtgggctcgccgcacggccacaggccgataccgtggcgctcggccaggtcggcccaagggaacaactcgcccgggtcttccttgcgggtgggcgccacgtcggaatggccgaccacgttgcgggccggaatgggatgacgctccaggattccccggcacaggcggatcagcgactcgatctgggccccgggaaacgcgcgatagccgaattcgtgaccgggattgaccagttcgatgccgatggagcgggaattgacgtctggctcgccccgccaggacgaggcgccggcgtgccaggcgcgcatgtcctcgggcaccagggcgaagacgcggccgtcttcctcgatgacgtaatgggcgctgaccttggcttgggcgtcgcacagccgggccagggccgcctcgcccgattccatgccggtatagtgcagcaccagggtgtcgacgatggccccggccgggcgcggctcgaaattgggcgaggggcgggaaatgatggtcatgttccgggctccggttcttccgcacggtggatggcgcggccgggcagcagttccaccacggcgacgcccagcacggtcagggcgccgcccaccagcttgtgccaggtcagcggctcgcccagcagcagcacgccaccggccagccccaccaccggccccagcagggtgaagggcaccacccggttcatggggtgacgggcgatcaggcgataccacagagtataggcgatcagggtcgagccgacgatggtgtaggccacgccgctccagcccttgatcccggtggcggccagcgcctccatctgcccgctttccgtcgccagcgacaggcccagcagcaagggcgaggccagcatggccatccaaccgttcagcgccaggggattgatggcgcctaagcgcttgatcaccacattggccaaggcccaggcgaagcccgaggccaccacggcgatgaacggcgtgaggcggggcaggtggggctcgccggccagcagggcgacgccgatgaacgacaccgccagccccaggctgcgccagactcccagcacctcgccgaagaaggcccaggccaggatggcggagaagggaatggacagctcgatgacgatggcggcggtggcggcgtccatgccggcgacaccgaagaacatcaggccgaaatgcccgacccccagcaacagggccagcaggaggatgccgggcaactgggcgcggctggggcggaagaacggcgccaggatcagcgcggtgcaggcgaagcgcaaggcggtcagcaggaagggcggcaaggtgcccaaggccgtcttcaccgccacgaaattgaggccccacagggtgaccaccagggtggccgaggcccattccaggggcgtgaggcgcgagggggcggtcatggccatgcgggcgggacgcccgcgctccggaaggagggggtcatggagcgcacctctccatgtcatcctgagccataggcgaaggatctttcaggcacgagcttcgggcatcacgggtgaaagatgcttcgctggcgctcagcatgacatcttgcacggtcacttcccccccgcctcttcccgcttggcctccagctccagccagcgtacctcggcgtcatccagctcggcgcgggccgcctcggcgcgggcggccagcgtctggaagcgggcggcatccttggcatagagggcgggatcggccaggtcggtctccagcttggcgatctccgccgtcagtttatcgatgcggctgggaagctggtccagttcccgctgctcgttgtaggacaggcgggtgcgggcgctttggggcttaggctgggcctggggcttggaaggcggcttgggcgcggcattggccggcttggcgggccgctggcgcagatagtccgaatagccgcccacatattccgagacctctgcgtcgccctccacggcgatgacgctggtcaccagacggtcgaggaagtcgcggtcgtggctgaccaccagcagggtgccgtcgtaatcggccagcacctcttccagcaggtccagggtctccatgtcgagatcgttggtcggctcgtccaggatcagcaggttggagggcttggccagcagctttgccagcagcaggcggttgcgctcgccgcccgacagggcgcggaccggggtgcgggcctgggcctcggagaacaggaagtctttcatgtagccgaccacgtgctggggggtgccccgcacccagacattgtcgccgcggccgtcggtcagggtgtcccagacgctcttgtcggggtcgagcgcggcgcggcgctggtcaaaataggcggtctccagattggtccctaggcgcaccacgccgccatcgggggccagttccccggtcagcatgcgcagcagcgtggtcttgccggcgccgttggggccgatcagccccacccggtcgccgcgcaggatgcgggtggagaaatcctggcagatgcgcttgtcgccgaacgccttggtgacgttttccgcctcgatcaccaggcggccggacaggtcgccggaatccgtggccagattgacctgacggccggcggccagcacctgggacttgcgctcggcccgctcgctgcgcaggccctgcaaggccctgaggcggcccatgttgcgcttgcggcgcgccgtgacgccgcgtgccagccagtgcatctcctggcgcatgcgggtattcatgcgggccagctccgcctcctcggcggcgaagacctcgtcctgccaggcggggaacttctcgaagccgaactcggcgcggcgcaccacgccccgctccagccacagggtctgtttcgacaccgtctccaggaagcggcggtcgtggctgatcatcaccagggcgccgccataggacgacagccattcctccagccacaagatggtgggcaggtccagatggttggtgggctcgtccagcagcagggcgtcgggctggcccaccagggcgcgggccagggcggcccggcgtccctcgccacccgacagcgccacggggtcgcgggcgccgtcgatgcccacggcatccagtaccgcgtcgacccgatacatctggtcgcgctcggcgggcggcaatccttgcgccacatagtcggcgatggtgggggccaggatgatggggtcctggggcagcacggcgatggaggcgccgggctggacgaagcgttcgccggaatcaggcagaatctcgccggccaggaccttgagcagcgtcgacttgcccgagccgttgcggccgaccagacaggtcttgtcgcccttggcgacccaggtggtgacgccttcaaaaagcggggtgccgccgaaggtcagacgaacgtcgcggagcgcgaggaggggaggtggagccatgcccgatggctacacccacggcgcccggttgtcaaaccgggtgcacgccgatttcgccccgccaaccggtctccgccccgggcgccccagggtggtgatagccctcgcggatcagggcgccgaccagttcggtgtcgtcgaccagaagatcgtgcatcagctcgaaataggcgccgagaaaggccggaagactctcgaacccgctgggaatctgcccggtcaggacggtctgcgcctgcttgatcaagcgagcgtggccgccgcaatgctcgtccacatgggcgccgaagcggtcccgaggcagcttgcgcagcaattgctcctcatagaagcaatgggcgaccagcaggcggaaaaaatcacggcacagcggcagaacatcctcgatgctgatggaagtttccgcctttgcttcgatttgtgcggagagctcgagaaggcgctggtgttcgcggtctattctttcgtgacccagggcgaaatgctcggaccagaccagtgtgcgcatgggacgcctccccgatggtccaccctttcgccagggtggggattgctgatggtcaattcaaccatgccgccacggccaaagtccgcccacgctttgaatcactctgtaaccatatctttcgtcagggttgtttttgccggcgacccgatgcgggctatggggtaacctcgcgcatcgggtctcgcccaaggaatgacgccatgccctatgtcagccgcgatgccctcggccgtgtggtcggattgtccgaacacgccaccgaggtcgcagccgaaagcttgccggccagccatcccgacgtgctggacttcctgttccgcgacaccgggaccgagcgcggctccgcccgctttctcgcctctgacctcgcttttatccgcgtggtcgaggatctggtggcggtgctggtggaaaagcgcctgatcgccttcaccgacctgccgcccgccgcccaggacaagctgctggatcgccggtccatgcgctcttacctgtcgggagtgtcgggggttttttccggcgacgaggaagccaagattatctgaacgtgcggatgtggcgccgctttaaaggcccatacgattggactaagctttcctggccgcatggaacggctcctccgggcccatgccgcccggagcggtcaacccgaaaggaaacgccaagatgtccgattgctgcaccgatgccttcaaggacctgtcccgccggggattcgtcaagctggccctgggggccggcgccgccctttgggtcaatttcaagccgagcatcagccttgccgccggcgggaccgaggccctgctgctgtcttgcatggattatcgcctgatggacgacatcgtccgctacatggatgggcgggccatgaccaacaagtacgaccatgtggtgctggccggcgcttcgctgggggtgctgcaggacaagaacctgtcctggggccagaccttctgggaccatgtccaggtcgccctggacctgcaccacatccagaaggtcatcgtgatggatcaccgcgattgcggcgcctacaaggtgttcctggggccggattcggccaaggacgcggccaccgagaccgcttcccacaccgccaagctgcgggcgctgcgcacggccatcaatgccaagcatcccaccctggcggtggagttgctgctgatggatctggaaggcaaggtcgagaccgtcgcctgatcccagggacgggaacaagccccccgcctggccggcggggggcctttttatggctacagctggacctggatgcccagttccaccacgcgacccgccggaatgcggaagaagtcggtggccgaaacggcgttgcggctcatgatgacgaacaggcgctcgcgccattcgggcatctcgggatgggtggacggcaccagcgtctcgcgccccaggaagaacgaggtgtccatcatctcgaattccaggccgaaggccttgcacaggcgcagcaccttgggaatgtccggctcctggaagaagccgtagcgcacggtgatgcggtagaagccctcggccagcccctccaccaccacccggtcgcgggcggaaacgcggggaatgtcctcggtgatcaccgtcaggaacaccactcgctggtgcagcaccttgttgtgcttgagattgtgcagcagggcgatgggcaccgtgtcggtgcctccggtcatgaacacggcggtgccacgcacccgcaggatcgaggtcgagtccttctgctgctgcatgaacatgtccagcggcagggcgccgtcggcgaggcgccgcgacaggatgtcgcgccccttgcgccaggtggccatcagcagcagcatgcccagccccaccgccagggggaaccagccgccctgggtgaccttcagcaggttggcgcccagaaagcccagatccaccgccaggaacaccgcgcccaggcccaggcacagccacagcggccagttccacgagcggtgggccaccaccagcgccaggatggtggtggcggccatggtgccggtcaccgcgatgccgtaggcggcggccagattgctggaactcttgaagccgaccaccagggcgacgatacccagcagcaatccccaattggcgcgcgggatatagatctgcccctcttcctcgtccgaggtgtggcggatatcgagacggggcgagtagcccagttgtaccgcctggcgcgacagcgagaacacgcccgagatcaccgcctggctggcgatcaccgtggccagggtggccaggatcaccatgggataaaggccccagcccggcaccagcatgtagaacgggttccgggcggcctcgggattgtcgaggatcagggccgcctggccgaaatagttcagcgtcagcgccggcagcaccagggcgaaccacgccatctggatgggcagcttgccgaaatggcccatgtcggcgtaaagcgcctcgccgccggtcaccgccagcaccaccgagcccatgaccacgaaggcgatccatccgtgggtgaacaggaaggtcaggccataggccgggttgaccgccatcaggatgtgcggatgtcccaccacctcggtcaggcccagggcggcgatggtcaggaaccacaccaccatcaccgggccgaacaggcgcccgaccagctcggtgccgtggctctggatggtgaacagcgccaccagcacgatcagggtcagcggcaccacatagggcgcgaagaacggggtccccacctcgaggccctcgatggccgacaggaccgagatggctggggtgatcatgccgtcgccgatgaacagggcggcgccgaacaggccgagccccaccagcggtcccaccaggccgcgatcgccgccggtggcgcggatggccagggccagcagggccaggatgccgccctcgccccggttgtcggcacgcatgacgaacagcacgtatttgatggtgaccaccaggatgatggcccagaacaccagggaggcgatgccgatgacgttttccggcgaggacggaatgccgtggtcggggtcgaagcactccttcagcgtatagagcgggctggtgccgatatcgccgtagaccacgccgatggcggccagggacagggctcccaggcgcttgacgccgattttttcggtgccggacttctcgccggcgggcttttcggtggcgggagtctccatggcctagatctcgatctgactgcccagctcgacgacgcgattgctggggagatggaagaagtccatggcgctggtcgccatgcgggccagggtggcgaacagggtgtcgcgcaagccccggagccccggcttttcggtgggcagcagcgtttcccgcgagacgaagtaggacaccgacatgggctcgtagaagaagcccagctggtcggtgcgggcatgggccagggccttggggatgttcgggctctccatgaagccgtagcgcaggaacacccggtggaagttgggcgccagcagccggttttccagccgccgctcctcgggcacgaagggcacttcctcgacgatgacggtcagcagcaccacgcgctcgtggacgatcttgttgtgcttcatgttgtgcagcagggcgatgggcacgccctcggaggtgccggtcaggaacaccgcggtgccgggcacgcgcggcacccggtccgacagcgaggccaggaagtcctctaccggcagggcgtcggccttcaggcgcgccagcaggcgcttgcggccgtccttccaggtggtgaggatggtgaacagcaatccgccgaccaccagggggaaccagccgccgtccgggatcttgatggaattggccaggaagaaggccagatccaccaccaggaagccgccgatcagccatttcaccttgcgcggattccacttccagatcagcagcatcaccgtgccgaccagcagggcgtcgatcaccatggtgccggtcaccgccacgccataggcggcggccaggttggacgaggtcttgaagcccaccaccaggaccatgaccatgcacatgagcagccagttcacgaagggcaggtagatctgccccatttcctcttccgaggtgtgaatgatctccatgcgcggcaggaagcccagctggatggcctggcgcgtcaccgagaaggcgcccgagatcaccgcctgcgaggcgatcaccgtggccagggtggccaggatcaccaggggcagggccaggctggccggggccagattgaagaacgggttggcgatggcttcgggattgtagatcagcagggcgccctggccgaaatagttcaggatcagggcgggcagcaccagcaggtaccaggccagccggatgggcaggcggccgaaatggcccatgtcggtgtaaagcgcctcggccccggtcaccgccagcaccaccgagcccagggccaggaaggcgtgccatccctcgcggaacaggaaggagatggcgtaatgggggctcagcgccgccagcacgctgggggcgtgcgacaggttgcggattcctaagatggccagggtcaggaaccataccagcatcaccgggccgaacatcttgcccaccaggtcggtgccgtggctctggatggcgaacagcacgaacaggatgacgatggtcaatgggacgacccattgttccaggtgaggggcggcgacctgcaatccctccaccgccgacagcaccgagatggccggcgtgatgatggaatcgccgtagaacagggcggcggcgaagatgcccagggcgctgaccatcagcgacaggcggcggttgctctcggcggcgtggctgaccagggccagcagcgccaaggacccgccctcgccgcgattgtcggcgcgcatgatgatgatgacgtatttgaacgacacgatgatggtgatggcccagaacaccagggacagcacgcccaggatgttgcctttgtccatggcaacggcatgcgggccgctgaaggtttccttcatggcatagagcgggctggtgccgatgtcgccgaacaccacgccgatggcggcgagcatcaggccggcgacgttgcgggactttccgtctccgccatgggccgtcatatcaggtgtcccccttagaaatgacggcacatggctactcatatcgcgtcaggagtcaagagcggttagcgtgacagcagatcctcgacgaacgcgggaactaggcgggaggcaggccccaggcgggattcgtggaacagcgacgccccttccgagggctccagattaagctcgaccgcctgggcgcggcccagccctcgcaccgtctggacgaagcccgccgccgggtagacatggcccgaggtgccgatggacaggaacagggcgcattgggccagtgcctcgaaaatgcgctccatgtgcagcggcacctcgccgaaccacaccacatgggggcgcagcgagccgacgcggtagcaatcggggcacttgtcctcgatccccaggtcccgggtccaggcgaagggccgggcgcatttgacgcaacggatcttcagcagctcgccatgcatgtggatcaggttttccgacccggcccgctcgtgtaggtcgtcgatgttctgggtcaccagcagcacttcgcccggccactccctctccagccgggccagggcggcgtgggccgcgttgggggcgacgccgccctcggccagattgcgccgccgcgcattgtagaaggcgtgcaccttggccgggtcgcggcgaaagccgtcgggcgtcgccacgtcctccatgcggaccttggcccagatgccgtccttgtcgcggaaggtgtccaggccggattccttggaaattccggcgccggtcaggacgacgatggttccattgccgggaagggagggcatgggagactcctgccgctggggaaaggtccatggaacccgagcggacttgagtggtcaagaccgcgtaacggcaatcattagcttgaaattatcatcaggcacatcatcatgaatgatgtattcgcagtaaagacaaccggaggtctgttatggctgttactgaagcgagtgaggttgtgcggcctgctcccgaaccgctgcttccctggcaggccatgaccatggggagcgggctcgtcctgcatggtccggccgacatcgcctgcgatcacggggccttggctgccgaattcgaccgcctggatgcgacgctggcccaggaggagcggcattgcttcggctcctgcgacggaagctggacgtccattcccctgacgggatggtcgggcggagaggtcgttctcgctccattggcccaagcaattcccgccgcggccggctttctctcgcgcctgcccggggcactggtgcgcgcccattacatgaggcaggggccggggcacgtgctggactggcatttcgagccccagtccatccaggacaaggaatgccgcctgctggtgcccatccatgccccgccccaggcctataccctgctcggccatctcgcggtggcttatcccgagggccaggcttggacgggcgatttcaatttccctcacaaggtcgtcaatcccagcgaccgggatcggatcatgctggtggtggacgtgctctcctcgccggacctggcggctctgttgcccgctgccctgggggaggggcgggacctgcggacccggctggccggggccgcccgcaatgccctggcgatgcagcgcgccgcctgagaattttgaccccggacccgggctggcgtaccatccgacccggccagacacggggcgtcgggctgcaggcgggagtgaggtcattggtcaaggttctgttcgtgtgcaccggcaatatctgtcgctcacccaccgcggacggcgtgttccgcgccctggtggcggccgagggactggcggagcgcatcggcgtcgattccgccgggacgcacgcctatcacgtgggcgagccccccgattcccgctccgccgaggcggcccggcggcgtggctacgaactgcaggacctgcgggcccgacagttgaagaaaagcgatttcgaggagttcgatctgctgctggccatggatcgggggcaccttgacctgatggcgcgggcctgcccgcccgagcgccgcgaccggctggcgctgttcctgtccttcgcgccgcaattggggctcaaggacgtgcccgatccctattacggccaaggtggcggtttcgagcgggttctggacatgatcgaggccggctcggccgggttgctggcccatatccgcgaacggatgctgtagccgcataaaacggatactctggggaatcaccccagggcgttgttgatcaggtattgggcgatgtcggccggcttgaccttgatgtccttgggctcttggccggtttccagcgccttgcggatgcgcatggaattttccaccttgaccgggtccaccttgaccagccccctggcgccgcgaatgcggggataataggtggggtccaccagcttctccttacggcccaggcgttccagcagggcggcctcgtcggtgccgtccgcggcctggtgggtcttgaccaggacccagtccttctcgcccgccagcccggcggccagaaggtcttccggcgctccatcctccacatagccgatggcgtagagattctttccaaggcccacatcggccccccaggtctgcaatcccttgctcctggccacatagatggtgcccaccgtttcctcccgtgcgtaaccggccggtcccaagggtacacgcctgcccaggcggcggaaagaggagggtttttttaagtactcccggatgtgtggttgtatatgcgtaaagttgtgtcgggaatatttcaggtcttgacccgattgtagttcgcgtcaccgattgctacataaaaacacgataaagaacattatcgccttccatccattggtattggggtgaaatccctacataccttggtatgttgagcaaaagactcaatttcgatgcgatgttgtcgctcgttaacttgcgagggacttcgctgttgggggtgcgctatggccgttcagtggcaagaggccatgtctatcggtgttgccgatttggatgccgagcaccgggccatgctcgaattgctcaacagcctggaggccggattggagggcggggacgatgatggagtcgccgacgccatgcgtgatctcgtcggcttgatgtccgagcatttcagccgcgaggaggatctgctgtccggcatcggctgccccagcttttacgcccatcgcgacgggcatgatgccattgccgaccgtatccacctgctgcggcggcgctatctggtggccgtcgattccggggcccggcgggacgtcgcctcggccttgctgaacttcacccgcatctcgctgctagaccacattttgacagaggatcacgccatgggtcgtagaatgtctcccgccgccatccagccgtccttggaccggtcatccgagtccgaagcgggggccacggtggtgcctgtcgccactcaggacgtggagtacagcctgccgccccacctggcccacctgctgaaccgcctgcattatacccaggccgagcttcccccgccgcacggcggctacgcgacgttcgaggtcctgtgcgccgaggcggtggcccggcggatcgacgaggtgctggtggtctttcacaagcgcaatgcctgtgtcagccgcaagctgccgccgcccttcttcctgtcgcccgaattcgcggatcgcttccgccgggtggtcgagcgcctgatcatgcccgagctgctgaagagccgccggttgcgccagatgacgtcacgctgcgactggaaggtcgtcgacagcgagagcttctgggaatacgtggataatcccctggccgaggatctgctggagcggtggcgcctggcctgggacgagatgcggctggtggagcgggtccgcgacgacggcagccgcgtcttccaggtcaaggagacgaccaggattctgcgcgagatgctgcagccccccacgcccgaggcctatgacctgccgcgcatcggcaatgtagagatcgagacgctgaaatccctgttcgatcccacccgcgacctggccggcgcgctgcatgccggttggcagcgctgccaggatctgtacgagcaggagatggagccccgcgtgtttcagcaaaaagcgcgcgaaggggcattgcgtgactacctgctgctggcgcatcagcaatatgccgccaattggggggagttcctgaccctgagcgtccaccgtgtgttcggacgggtcacctcccattttctcgagcggttcagcaccagcctggggcggtccgagcaggagagggccgggcacatgccctatctcatgcgctatctgcaccagctgcgcgaccatcccgaaatccgccgccaggagcgggaggaggaggcccaatggcaggcccagcgccaggagcttcaaaacttcctgaaaggcgtcaccgccgccgcctgagaagccgggtcccagccacgatcggcagggcgggtgcttgtgtgaagtccttcatggaagagaacccggtgcaaaagtatgaatgcgatgaaatttcgccttcttcgggtggggaccctattgagctgggtgaccgggcaaggtagatcgtagcgagtcactgggggaaatacgtagatgcttgccaccgcggccctgtccgagcggcctgtcctcgccattcgctgccatgcctgccgctacttcacgctggagcgctgctgcaacgcgacggccaggctggagggccaggacgaccgggatggcgagtgcccgcacttccgctttgggctgtcctcgggcccggcgcaggaatggcaactgcgctaggcctgagtcatcacctgacgggcctcagcgccccgccatcacgtaatcgcgcagggattccgcttccatcttggtttcgtccagccgggacttcaccacgtcgccgatggtgacgatgccggccacgtcgccgttgttgtccatcaccggcaagtgacggatgcgcttggcggtcatgatctccatcagacgttcgacggtgtcgtcctcgtggcagacgaagacctcggcggtcatcaggtcccgcaccttggcggtgatgcagacgtccaccgcgtcggccaggcctcggacgatatcgcgttccgacaggattcccgccacccggtcgccgttcatgaccagaacggcgccgatcttgtgttgggccagcagacgggcggcgtcgccgatactggcctcgggggtgacggagatgatccctccgcctcgggccttggatttcaagatggtcttgacgatcatgcgcaccctccctcgctatgggatcttcaggctctccccctcacagattggggcagggggaagtcccttcaagggaggggggcatcagtataggagcttgatcgcctgggcccgctcgtcggccggcagggtctgattgcccaaaaggtagtggagcgccgtgcggccgcgggcatcggcccggtgggggtcggccccggccttcatggccttttccacgtcggccaaacggcccttggcggcggcggtcatcagcggtgtcttgagatcgcgcggcaaatggccgtggccattgctgaccgaggtcagggcgccggccggatcgcgggcgatacgctccagcaggttgaagtcggattcgcggcccttgggcgtggggcaatcggtcagcggcccgcccatgagaggtcccatgcgcttggcggcctcttccagcagggcgcggtggttggtgacgatccggcagggaaagcgcaggttcatgccgtcaaacaccgagggttcgggttcggacttgcgggccaccagatcatagcccttggtggacggcatggtctcggccagcaggatggcctcgaccttgcggagcgtcagggcatagcggatgaagacataggtgtcggccttgacgcccttgccctggggggcgtcgggcagcaattcgaaatagctgaccagccattcctccttgtcggccagcagcgggtcggcggccacctgctcgtcggtggggacccgaaggtcgatctcggcatcgatgtcgtcgagcatgttggaggccttgaccgtgttgccggccaggaactccctgagcgcgccgccgatggcttccagcttgtcggcattggcgtcggcgggcagggcggggcgcccggccccggcgcggttcatctcggtctggatgcgggcgaaggtgaccaggccgtcgcccggcaccgccgccagctcgtcgccgccggaggccggggtgcggcccgccaggaaccaggcgccggtccccgccgccagcaacagggcgcaggcggcggcgatgaccgtatgctttgacatggggcgcgtcctaacgcttcagcggcttgtacttgatgcggtgcggctggtcggcgtcggtccccaggcggcggtgacggtccgcctcgtaatcctggtagttgccctcgaaccacaccacctgggaatcgccctcgaaggccaggatgtgggtggcgatgcggtccaggaagaagcgatcgtggctgatgaccacggcgcagccggggaattccgccagggcgtcttccagcgccgacagggtctccacgtccaaatcgttggtgggttcgtccaggaggatgacgttggcgggacggctcagcatcttggccagatggacgcggttgcgctcgccgcccgacagcacgcccaccttcttctgctggtcggcgcccttgaagttgaacaggccggcataggcgcgggcgttgatcttgcgcttgccgagatcgatttcctcctggccgtcggagatttcctcgaaggcggtcttgtcgggatccagcgaatcgcggctctggtccacatagcccagcaccacggtctcgcccacggtgaagctgccggtggtgggttgctcctggccggtgatcatgcggaacagggtggtcttgccggcgccgttggggccgatgatgccgacgatgccgcccgggggcaggcggaagttcaggttctcgtacagcaggttgtcgccgaacgccttggagacgttctcggcctcgatcaccttgccgcccaggcgcgggccgggggggatggagatgacggcggggccggtggccttttcctgggacttggccaccagatcctcgaaggcgctgatacgggccttgctcttggtctggcgagccttggggctggaccgcacccattccaactcgtcgcggatggcgcgcatgcgggcggtctcttcccgctcttcctgctccaggcgcttgcccttctgctccagccacgaggtgtagttgccctcgtaggggatgccgtggccgcgctccagttccagaatccagccggtgacgttgtccaggaagtagcggtcgtgggtgatcatcaccaccgtgccggagtaatcctccaggaagcgctccagccaggccaccgattcggcgtccagatggttggtgggctcgtccagcagcagcatgtcggggtgcgacagcagcaggcggcacagggcgatgcggcggcgctcaccgcccgacagggtggtgacgtcggcatcgcccggcgggcagcgcagcgcgtccatggcgatctcgatggtccgcgtcaggtcccaggcattgagatggtcgatcttttcctgcaactcgccctgttcggcgatcaggtcgttcatctcgtcgtcggaaagctcctcggcgaacttggccgagacttcctcgaaacggtccagcagggccttggtctcggccaccgcctccatgacgttgcccatgacgtccttggcggggtccagatggggttcctgcgccagatagccgatcttgacgccctcggccgcccaggcttcgccgccgtattccttgtcgatgccggccatgatcttcaacagggtcgacttgcccgcgccgttgacgcccagcacgccgatcttggcgccgggcaggaagctgagggtcagccccttcatgatttccttcccgccgggataggccttggtcaggttcttcatgacatagacgtactggtacgaggccatgggggctctccgcttgggcgtggtcgatttgggagattgagtagacgggtggggccgccccgtcaagcttggcggctcagcgcgagacgatcaggtgggggaccccaggcagttcggccagcaattcctcggccagcaggcgggaccatggcttgtcggcggtgaacgaggcctccagcgccgcgtcgcaacgcatctgccagtcgtccatgggaaacagcgccacccattccacctggtcgtcgaacaggaagaccggggctagcacctcgcgggtcatgcgccacggcgtatccgcatccaggcagcgcccgctgttctgcagcagaagccgcggcccctcggccgactggaccagcaccgcgtggcggccatgcccggtctcgccgcatatggcggcggtaaagcgccggaaggtggaatcggcggcggcgtcgtccaggctgatgcggaatacctcgggcttggccatggggtgtgctccttcaaggggccatcagagcatggcggaagggaaagcccccttgatgcccgtcaagggggctttccttgctcccgggcctccgggcctataggctggcggcatgaaaaagcccaagatcgtcccgattccgtccaagcaggaaattctcgacttcatccgatcccagccgggaagggtgggcaagcgcgaactggcgcgggccttcaacctgcggggctcggacaagatcgacctcaaggccatcttgaaggagctggagcgggaaggcgtggtggagcgcggccagaagcggcgcttcgccagtcccggcaccctgcccgacgtgggcgtggtggagatcatcggcaccgacagcgacggcgaattgctggcgcgtcccttgaactacgagggcgagggccgcccgccgcgcatcttcatggcgccgttccgggcgggcgaggcggcggtgggcgtgggcgaccgggtgctggccaagctgaagcgagtgcgcggcgaggacgtctacgaggcccgcgccatccgcatcatcggcgaggcccgtgcccgggtgctgggcgtgttcgagcccaatcccgacggctcgggccggctgcgccccacctcgcgcaaggaaaaggccgagtatatggtgccccggggcgagaccggtgacgccaaggccggcgaactggtgctggccgacatcatgccgggacggctttacggcatgcgcaccgcctcggtgaaggagcgcatgggcctgctgggcgcgccgcgctcggtcagcctggtggccatacacaccaacgacgttccctttgaattcccagaggccgcgctgcagcaggccgcagccgagggaccggcccccatgaacgagcgcaccgatctgcgctccattcccctggtgaccatcgacggcgaggacgcccgcgatttcgacgatgcggtgttcgccgagcccgatcccgaccccaagaatcccggcggctggcactgcatggtcgccatcgccgacgtctcctggtacgtgcggcccggtgattccctggacaaggaagccttcaagcgcggcaattcggtctatttccccgaccgggtggtgcccatgctgcccgaggaactgtccaacggctggtgttccttgaagcccgacgaggaccgcccgtgcatggcggtgcatttctggctggacgctctcggcaacaagctgcaccatcgtttcgtgcgcggaatgatgcgctcggtggcgcggctgacctatacccaggtgcaggcggccaaggacggcactcccgacgacaggaccggtccgctgctggccccggtgatcgagccgctgtacggcgcctgggcggcgttgttccgcgagcgcaaggaacgcggcgtcctggaactggacatccccgagcgcaaggtgaccatcacccccgagggcaaggtggaggccattaccgagcgcgagcgcttcgacagccaccggctgatcgaggacttcatgatcatggccaatgtctgcgccgccgagaccctggagaaggttcacaagccctgcatgtaccgcatccatgacctgcccagtcaggagaagctggacggattgcgggaattcctctcctccatggatctgaagctggccaagggtcaggtgctgcgccccgcccatttcaaccgcatcctggaagcggtggagggcaccgccaattcccatctggtcagcgaggtgatcctgcgctcccaggcccaggcccagtacagcccggagaatatcggccatttcggcctggggctggcgcgctatgcccacttcacctcgcccatccgccgctatgccgacctgctggttcatcgtgccctgatctcggggctgcatctgggcgagggggggctgcctgcggatgcagtcgcagagttcgccgaatggggcgagcacatttcggtgacggaacggcgcgccgccaccgccgagcgcgaggcggtggaccgctacgtcaccgccttcctggcggacaaggtgggcgccacctttgccggcaaggtgtcgggcgtcacccggttcggactgttcgtcaccctggaccagacgggggccgacgggctggtgcccatctcgacgctccctgaggatttctacgtccacgacgaggtccaccattgcctggtgggcaagcgcacccgcaagacgttccaactgggccagaagctggacgtggaactggccgaggccaatacgctgaccggctccatggtgttccgcctgggcggagccggggagagaggcctccgcccgccgcgtccgccgcaatcgggccggcccaagcgctcgttccggagccggacgcggtgaccgcgccgccccgcgaggacatcgacgaccagggatacttcctggaggcgctggcgcggggcattcggatccatcacacatcgacgctgccccactttcaggcggaggctccggtggaaatccgctccggtgtcctggccgaacacgcgctgttcctcggggcctacagctatatctccgaggacacccgcctgtggacccccacgaccatcggccgctattgctccatcgctcccaattgcgacatcggcggcgtcgagcatccgaccgactgggtgacgacgcatcccttcgcctgggggcggctgcccctggaccactggccggccatgaggcaggcccggaaatcgccccacgagtgcctggcccccgtcgccatcggccatgacgtctggatcggcgccggggcctttgtccgcaatgggctgagcgtcggcacgggagcgatcatcggcgctcgcgcggtggtgacccgggatgtgcctccctatgccatcgtcgccggaaatcccgggcggatcatccggcaccgcttttcccccgagatcatccgccgcctgctggccagccagtggtggcggctcgacgtcacggcgctcgaccattttcccctgaccgacgtggagcgcttcctggcccggatcgagggccggatggcggacgggcttgccgtgcgatgaaacctctgtacccggcggcggtcgcttgcgcataatccccccgatgagccgattcacgcccctgggagccgggttcgccctggccgtgtccctgctgtccccccccgccgccgccggctgggtggcgggcgaggccgagcgcaccatcgccttcggcttcgacgccatcgtcgagcgccatctccagccggtcaccgcccagactatcgccctggacgggctgcgcggtctggccgagatcgatccgcaactggccgtcaccctggaccaggggcggctgcgcttgtccaccaccgagaaggtggtggtcgattttcccgccgcgtcccccgacgacacggtgggctgggcgcgcatcaccgtcaatgcggccctggaggcctcgcagatgtcggagcggctgcgcgacgccgatgccgagcggctgtatcaggcggtgttcgaaggcgccttgggcaaggccgacctgttctcccgctatgccggggcgcgggaagcgcgcgagcaccggtccaaccgctcgggctttggcggcatcggcatcaagttcgacctgatcgacagcgaggtccgcatcgtcgaggtggtcgacgatggccccgccgccaagctgggtctgcgcgccggcgacatcatcaccgccatcgacggcgatccggtccgggggctggaccgcgccgacatttccaacaagctgcgcggcgccgtcgccaccgaactggtgctggcgctgcggcgcggcagccagatgctgcaattcacgctccgccgttcgctgatcgtccctcagacggtgagttcctcggtggcgggcggcatcgcccatttcaagatcaccagcttcaaccagcgcaccgcctacagcctggaaaaccagctgaaggacatccgggaccgcctgggcggcggccttcagggcgtggtgctggacctgcgcggcaatcccggcggcctgctggacaaggcggtggcggtggtcgacctgttcgtggccgagggcaccatcatctcgacccgggggcgtcatcccgcctcggccaattccttcgaggccaagcccggcgacatcggcgaggacctgcccctggcggtgctggtggacgggcggtcggcctcggccgccgagatcgtcgcctccgccttgcaggacgcggggcgggccgtggtcatcggcaccaattcctatggcaagggcaccgtccagacggttgtgcgcctgcccaatgacggcgagatcaccctgacctggtcgcgctttcatgcgccgtcgggctatgccctgcatggcctgggcgtgctgcccgtgctgtgcactggcgccgccacccagaccgccgcccagatggtcgaggccatcgggcgcggcacgctgccgggcaagccggccgagaccctggcggtgtggcgcggcaccggcatcgacgataccgagctgcgccaccgtctgcgcgatacctgcccgccggcccggctgggcgacaacaggctggagatggatctggccgaccggttgctctccaaccgcgccgcctatgcccgcgccctggcggcttcggcccccaccagggggttggaggcgctgcagacccggccctcgccggaaaccggatcgcactgatcatggtgccggccgactggatcgggcggacggagacggtgcacgacatggcgtcccatgcgccgctcctcggtctggccgccactctggatcacgccgatccgccgtgggtggcgggcgaggtgccgcccctggggcactggctctatttcctgccccgtgccctggagcgcgacatcgccgccgacgggcatccccacaagggcggctttctgccgccggtggaactgccccggcgcatgtgggcggggggcgagttctcgttcatggcccccatcccggtgggcgccgccatcacccggcgctcgaccatcgccgacgtgacggaaaagaccggccgctccggccccatggtgttcgtccgggtcgagcatgagatctccacccagtccgggccggcgatgaccgaggtccaccacattgtttaccgcgaggcgcccaggccgggcgaatccttgccgccgggcgagccggaaccggcccaggccgcgtggcggcggagcatgcatcccgacatcgtgctgctgttccgctactcggcgctgaccttcaacggccaccgcattcattacgaccgcgagtattgccgcgacgtggagggctatcccggcctgatcgtccacgggccgctgatcgccaccctgctgatggacctgtttctgcgccacaatccgggggcacgggtcaccggctttacgttccgggccagacggccgctgttcgacatccatcccttcgaggtcgccggacgcccgacgccgggcggcgccgagctttgggcggtggatcaccagggcaatctggccatgggcgcggacgtggaggccgtttaataccagatcccccctcccgccctccccccaccaggggcggggggaggggaagaggatgggtcagccgatggtgtagccgccgtcgaccacgatctcctggccccagatattcttggcctgatccgagcacaggaaggcggcggtggcggcgatgtcgccgggctcgccgaaggcgccgggcatcaggcgcgccgtcacctgggtggccaccgcctgcaacacgtcggccggcaggccgatgctgccccagatgggggtgccgatggggccgggggcgaccgagttcacccggatgcccttgggggccagttcggcggccagggtctgcgagaacgacttcagcgccgccttgctggcgctgtagatggccaggccgggaaagccgacctgggtcaggaaggtggtgacgaacagcaccgatccgccctggcggatatggggcaggaagccgcgcaccgtctgcaccgcgccggtgaaattgacggcgaactggtggtcgatggccgccgcgtcgctctgctcgaacggcaccaccttggcgatgcccgcgttggggatgaccatgtcgacgccgccaaaccgcttcaccgtttcggccaccagccgttccaggtcggcggcgcaggtgacgtcgccggtcaccgccagcaccgaatcctcgcggcccttggcgaggtcggccagggcggcggcattgcgggcgaagacggcgaccttggcgccttcggccaggaagcgctgggcgatggcatggccgatgccgctgctggcaccggtgacgacggcgactttgccgctgagggaactggtcatggtgactatatccttggacagggagggatgagccaaaagcgcacggatggcgcccggaccgctttgaggccggtcaagccgccccctccattcccgacgacgtttgcgctttgttatcgattgagatacggtttattgcctatctcaggataatccattcgtatcggtctgctatgtcaggcccagatatatccttgctctggaaagggatgaatgatgcggatctccgatgtcctggcctataaggggcagacgatccacacggtggcgcccagcgcctcgttgcgggaggcggcgtccctgctgctggaaaagaatatcggagcgctgatctgcgccgaccgtgccgggggcatcgtcggaattctgtccgagcgcgacatctcccgggccttcgcccggctgggcgccgatatgatcagcatgtcggtgggcgatgccatgacccgcgacgtcattgcctgcgccgccagcgacagcgtcgcggaaatcctcgacatcatgaccgagacccgctgccgccatattccggtggtccaggacggcgagccgcggggtctggtttccatcggcgatctggtcaaggccatcaaccgggagggctgagcctcccggtcttcggtccaagattacttcttcacggcgaccaggtcggcgtcgcccttgtccagcaccagggtgtgctccagcgagacatagtggaagcgccgggcggtgtgcccggcatggatggcgaaacccagattgtaggtcttgcccacctcgatggtcttgaacggggcggaggcggccagcgggcggctgagcgtcacgctccagccgtcgccgctctgggtggcctcggcggtcacgggcgagggcttggcctcggcgcgcttgtcgaaaatgaagccgccggccgccactgccgccgcgccgggcttcaggcgggcctgccagtattccatcacctgaccggaggcctgcatcttctccagttccgccgccgccaccagttcgtcgccggcgccctgtcggcccggcttggcgcgggtgcggttcaggtatttggtgcgctcgccggcgcccccggccggcatcttggccgcgtcctcgtggcaggtgccccagcagccggcctgcgccgcttcgggcagcttgccgtcgtcgagcatcatggtcaccttggtggcgaagtcggcatccatcttggaatcgggctgggcgccctccttgaagtccaggcggacgaggagcttgccgccctcctgggccaccttgaccgtggcggggatgaaggcgggcttggccggaatgggcgcgggttcattcttggagcccgacaccagagtggcgcccatgtccttttcctcgcccagatggcactccttgcaggccttgccgttcttgaccttgggcgccccgccgtgctcgcccgacagcacccattccagcgacgactggccggggtagaacaggacgatctccttgcccggcacgctgccccagtccagggcgagggcgggggtggcggcgaaaaccatcagggcggtgagcgcggtgcgtttcatggcgggcttcctggttgcgggaaggcgacctaaccacagggcggaggccggtgacttgaccttgctcaatgcagagccggggatgtccacgtaaccagtctgaaatctgcatgattttggagggcgggccatgaggatcggtttgggtgcggcgctgctgatggccgggctggttgccgccgcggcaaccgcgacggcccagcaggcgccgatcatgatcaagggcgagccctatgtttacgacaaggacaacgcccaggacgtcatgcgcatctgcgccggctgccacggcgagctgggcaatggcggcggcggcggcgcctatccccgcctgggcggcctcaacgccgactacttggccgagcagatgcgcaagttcaagagccgcgagcgcgagaacatcccgatgatccccttcgccgtggatcgcgaactgtccgagcgcgacgtgctggacgtcacccgctttctctccgaggtcaagctggagaccaagccgccggccaacatgcccgccgacggctatgcccggctgcagatcatgaagaaggtgctgcagatcccgcgcgagccgggcgacgtggaagccggcaagacgttctatgccgccgattgcggcccctgccacggcaacaagggccagggccgcctgaagaagccggccatcgcgcctcagcacatctcctatttgaaggtccaggtggacagcttcctgtcgggcaagcgcaagcatgacgacctggaggtgatgaaggccaagacccccgaggaatggaagaacctgtgggccttcctgtccagcctgcaggactgacatcgccggacttgctttcacgggccgggcggaatatctgaaaggcatgcctacgcaaaagactaccggctatctcgccggacagattctgatcgccatgccgcagatggaagacccgcgcttcgcccgcgccatcgtctatctgtgcgcccataccgccgacggggccatgggcatcgtcgtcaacaagctgttcggcggcctgaccttcccggaattgctggaacagctggaaattcccgccactcccgcctgcgacgagatccgcgtccatttcggcggcccggtggaaagcgggcgcggcttcgtgctgcattcggccgattaccagcacgagaacaccatgctcgtcgagggcgacgtggccttgaccgccaccgtggacgtgctgcgcgccatggccgacggcaccggcccgcgggaaagcctgctggcgctgggctatgccggctggggctcggggcagctcgacatggaaatccgcgagaattcctggttgaccgtgcccgccgatccggcgctgctgttcagccgggatctcgaacacaaatacgagcgcgccatccacaagctgggcatcgacgtgggcctgctgtcggccagcgccggccacgcctgaaacaagcccttaacgaaactccgtccgcgcatcgcggatgcccgccgggtcctcgtggatgatcacgtcgaagccggggaattccgccaggagggccttctccacatcgtcggagatgcggtgcgcctcgaccagcggcaggttgccgggcaattccagatggaactggatgaagccctggcggcccgaagtgcgggtgcgcaggtcgtggtggtcctgaacgccgggatgggcggcgacgatggcgcggatgcgctcgcggtcggcttcgggtagttccttgtccatcaaggtgtccagcgacagccggaagatctgccaggcgttgatcatcagccagccggcgatgccgatggcgaacagcggatcggccaggggccagccggtgcccgccgccagcagcagcgagacgatgacgctggcattgatcaacagatcgccggtgtagtgcagggaatcggccgagatggccagtgagccggtgcgcttggccaccatgcgctggaatcccaccagggcgaaggtggcggcgatggagaacaccatcaccgcgataccccattcgccgtggctgaccggctgggggtggaccatgcggctgccggcctcggccagcagaaaaccgcccgagcccaccacgaaggcggcctgccccagcccagccagggcctctgccttgccgtggccgaagcgatgctcgtcatcggccggcaccagggcatggcgcaccgccatcagattgagcgccgaagcggccagatccagggtggaatcgatcagggtggacagcagcgccaccgagccggtggcgagccaggcgcccagcttgacggcgatcagcaaggcggcggtgccggtcgaggcgtaggtcgccagccgcatcaggcggccatggtcggctggatggctcatgggtagaggtgctccagatgccagccgtccccgtcgcggacatagtcgaagcggtcgtgcaggcggaacggccggtcgtgccagaattcgatgcgtctgggcgccaggcggaagcccgaccagtggggcgggcgcggcaccttgcccaggccgaacttggcggcgaattcgcccacccgcttctccagctcgaaccggccggtgagcggccgcgactggatggaagcccaggcgccgatctggctggcccgcgcccgggtggcgaaataggcatcggcttcctcgtccgagacccgggtgatggacccttcgacccggatctggcgccgcaggcttttccagtgcaggcacagggcggcatggggattggcggccagctcctggcccttgcggctttccaggttggtgaagaacacgaagccgtcctggtcggcgcccttcagcagcaccatgcgcacgctgggccgtccctccgcatcggcggtggccagggccatggcgttggggtcgttgggctcggccttttcggcctcgtccatccacttgtggaacaggaccagggggtcggcttcgggtgcggacattctctcaccggcgggtgttgacgcgacgccctcaaaatgcccagattcaaggccatatggtagacgtttcgtcgcatacccccttttcatgagaccgccatgcgcccccaggcccccaagttcgtttccgcccttctcgccctgtcgctgctgggcggctgcgccgatgccaagctcgggcagaccggcggcgccatcctgggcggcatcggcggcggcctgctgggctcgcagttcggcggcggcatcggccgggtgctgatgacctcgctgggcgccgccctgggcgcctatgccggttcggaactgggcaagaagctggacaaggccgacaaggaagaggtgctgaaggccgaggaaaaggcccaggacggcccggtgggggaaaccatcgcctggagcaatccccagtcgggcaattccggcacggtcaccccggtgagcgaaaacaccgacgcccagggccggacctgccgcgactaccagtcgaccatcaccgtggacggcaaggacgagacggtgaccggcaccgcctgcaagcaggccgacggctcgtggagcgcggtgaactgacctcgctcacgcttccttaacctgaacggcggcatggtcgcgggttggcgatgccgcctttttccattgcagccgggatgacgacgcggtgaaggatccttatctggtgctgggcgtggcccggaccgcttccgatgacgatatcaagaaggcctaccgcgccctggcgcgcgagcttcaccccgacctcaatccgggcgacgccaaggccgaatcgcggttcaaggacatctcggccgcctatgacttcctgtcggattccaccaagcgcgcccagttcgatgccggcgagatcgacgccaccggcagccccaagcgcggcgcctggcggtcgcgccccggcgcccggccgggtcccggcggcggcggcccccggggcggtttcggcggcttcggcgagaatgtggacgacatcatggccgagctgttccgccgcaagcagaaggcccagtcccaggcccatgccaaggccaggccgcggggcggcgatgttcgccacaccctgaccatctcgttcctcgacgcggcggcgggcgggaccaagcgggtgaccctgatgtcggggcgcaccgtcgaggtgcgcatccccccgggcagccaggacggccagaccctgcgcctcaagggccagggccacggcgccgatgacggagccgtgcccggcgacgccttcatcgagatcaaggtggaggaccattcccacttcaagcgccgcgacctggacgtgctgctcgacctgccggtgacggtgcaggaggcggtcctgggcggcaaggtgccggtgccgaccatcgacggcaaggtgatggtgaccatcccccccggctccaacaccggggcggtgttgcgcctcaagggccggggcatcgccggtccgggcaacacgcggggcgaccagttggtcaccctgacggtggtcctgcccgaagacggagaattccgccagttggtggaaaagtgggggccgcgccacggctacgacccccgcgccaaggcggggctgacctgaggtctggaccatcgagcgtcaaagatgacgcccaatggtccaggattcatatttgcccctcgccgggcgcggccctccggccgcttggccgcggcctcaatggccgctaaagcaacctgcgtcagatctaacgcaggttgctctctttccccgtcccctccttctttttcatgtgcttttccatcatggcgcaggaatcttcgcgcgtggcgcggccggtgaaccagatcaggtcgaagggcggagtccgggtgccgaaggattcgccgtaggcggcggggctggtcttgccgtcctccacttccacgaagccgatggacagcatggcgacgcccggcaccatggcgcgcaggcgggccggcacgccccggtcggtgcgggcatggccggcgccggcgatcagcaccaccggtccggcttcgggccgcgaggcctgatcggccatcacttcggccatggcggcgtcgcgggcccgctgcacccggaccatgggcggcaccgccttgtcgggcagcaggttgcaatgaccctcgcggatgtcggcggccagggccttttcctcggccgggggcaggggctggtccaggccgaagcgtccatccacctcggcgccttgctcgcccctggcgatgcggcgggtcaggtcctggggcagattggcggccttgacctcgccccgcgccgccagggtggcctcgacgatcgggcgatacagcgcccagtcgggccagccgcgcttttcccagtccagcgccgcgcccagggtggcgggggtgccgatcccctggtccagcaccgcctgccggtcgctgtccaccatctccagcgccagcagggggcggcggccggcggcggccagttcggtcatcacccaggcctgcagggcgtgatggtcggcgttgtcgtgaatctcgcccagcagcacgatgccggcgcccttcacccgctccagggcgtcgtcggggctggaccatttgccagtggccggtgcccagacccggctcgccaggggatgatctgcggccagggtgggggcgggcggcgatcctgccgaggcgggcgctgcgcaaacacaggccaggaacgcgaatcgaacgagcgttcggctcatctggtcaaggtggaggggttgcgttatggtcataccaaacccttctaataagacatcaatgcttgggaggcatcatgaagagggtcgtattcggggccgttctggccaccattctggcggtgccggcttttgccgccgatcaattcctcaacattctcaccggcggcaccagcggcgtctactacccgctgggcaatgccctgtcgtccatttacggcaaggcgctgccgggggcgcgggtcaccgtccaggccaccaaggcctcggtggagaatctcaacctgctgcagatggggcgcggcgaactggctttcaccctgggcgattccctgacccaggcctgggacggcgtcgaggaggccggctacaaggcgccgctgaagaagctgcgcaccatggccgccatctatcccaattacatccagatcgtcgccaccgccgattccggcatcaagaccctggccgacctcaagggcaagcgggtgtctgtgggcgcgcccaaatcgggcaccgagctcaatgcgcgggcgattttcaaggcggcgggcctcgcctattccgacatgaaggtccagtacctgccgttcggcgaatcggtggagctgatgaagaacaagcagctggatgccaccttgcaatcggccgggctgggcgtctcgtcgctgcgcgacctggccaccggcgacgatatcgtcatcgtcgccatctcgcccgaggtgatcgccaagaccggggattcggcctatatcgcctcggtggtgccggccaatacctatcgcggccagaccgtggacgtgcccaccgccgcggtgcgcaacttcctggtcacccatgaaggcgttcccgccgaactggtctatggcatgaccaaggccatgttcaccaacatgcccgacctgctggccgcccattcggcggcgcgcgagatcgatccggcccatgcggccaaatcgcccatcccgctccatcccggagccgagaagtactatcgcgaggccggattgttgaagtgatgccgtgaaggggggaaggccatgagccagcaggacgaaaaggatgtcgatctcgccgagatcgacaccaagggtgaagtgttcggccatggcgtcgaatccagggggattttctggatcgccatcgccttctccgtcttccagatcgtcacggcggcctattcgccgctgtcgtcgttgccggtgcgctccatccatgtgggcttcctgctgctgatggtcttcgccctttacgccgccatggggcggggcaatccggtcaaagtggccaccgcctgggccttgggcgggctgtccttcatcctgtcgctctatcacctgatatacgagggcgagctggtccagcgctcgggcgatccctcgaccaccgatctggtggtggggaccgtcatggtggccctggtgttcgaagcggcccgccgcctgatgggctgggccttgccggcgctttgcctggtgttcgtggcctatgccgccttcggcgagatcctgccggcgcccctgggccatcgcggctatggtttcgaccagatcatcaaccagtacttcctgggcaccgaggggatcttcggcatcccctgctatgtctcggccacctacatcttcctgttcatcctgttcggcagctttctggagcaggcggggatgatccgcctgttcaccgatgtggccctgggcacggtgggccataccaagggcggtcccgccaaggtggcggtggtgacctcgggcctgatgggcaccatcaacgggtcgggcatcgccaatgtggtgaccaccggggcgctgaccattccgctgatgaagcgtttcggctaccgctcggaattcgccggcgcggtcgaggccaccgccagcatgggcggccagatcatgccgccggtgatgggcgccgtggccttcatcatggccgagaccctgaacatctcctatgccgaggtgtgcaaggcggcggccattccggccctgctctactacgcctcggccatctggatggtgcatctggaagcgggcatcgccgggctgcacggcatgcccaaggaccagtgccccagcgcccagggggctctcaggcggcaatggtacctgatggtgccgctggccgccctggtctatctgctgctggccggcttcacccccatgttctcgggcacggtgggcctggcgctgaccgccatcgtcatcctgggatcaagcatcgccgccaatatcggcggcatggcggggcgcgtggtgttctggggcgtgctgggcatcgcctcgtccgccttcttcaagctgggcatcaatgtggtggtggtgaccgtcgccgtgctggtcggcgtcaatttcttcgtgcgcggcgggcgcgagaccatgcgcatgaccgtgcgcggcctggtggagggcgcacgctccgccgtgccggtgggcgtcgcctgcaccctggtgggcaccatcatcggcaccatgaccctgaccggcatcgccggctcgttcacccaggggctggtctccatgtcggggggaagcctgtttctgaccctgatcctgaccatgatcgcctcgctgatcctgggtatgggcattcccaccattcccacctacatcatcacctcgtccctggtggcgcccatgctgttcaagatgggcgtgccgctggtggtgtcgcacatgtatgtcttttacttcggcatcctggccgacctgacgccgccggtggggttggccgcctttgccgccgcctccatcgcgcggtccaatttcttcgtcacgggatggtgggcggtgcgcgtcgccatggcgggattcgtggtgccgttcatggccgtctacgatccctcgctgatgatggtcagcggctcgctgttcgatacggcctatgtggtgatcaaggcgctgctggccatcggattgtggggggcggcgaccatcggctatctgtgggcgcccatgaagatgtgggagcgggcggtggcggtgctggcggccttcctgttggtggcggcggtgccgctgaccgacgagatcggcttcgccttgtcggccgtgttcctggcctggcactggatgcgggcgcgccgggtggcgatccagggggcatgagcggcctgtgcatggtggtggccgccggtctggcggtcctgacgccctcggaccacttcaccctggcctggacccattcggtggaaaaggtggagtggcgcgaggattggcgggtcgagtccggccggctggcgctggatcaagcctcggtggcgggcagcggcgccggcatggaaccgccgcccgaggctgttcttcgggatgaccgctgggtgtggtcgccggggatcgtcatggacgagatcgttctggcccgctcggatttcaccgccgactggcgcctgtgcgtgaacggcgtctgtggtgatctgaaaaaagaagaggggcagacccggctgcgggcctgcccctgaggctttacatcacccccaacgcccggggcagccagatggacagcggcggccagtaggtcaccaccatcaaaaagcccagcatggccagcagccagggccacaccgccacggtcagctcggtgatgcccatcttggtgattcccgatgccacatagagattgaggcccaccggggggtggcacatgcccacctccatgttgaccacgatcaggatgccgaagtgaatcgggtcgatgcccagcttcatggccaccgggaacaggatgggagccatgatcagcacgatggagctgggctccatgaaattgcccgccaccagcagcagcacgttgaccaccagcaggaaggcgatcactcccaactccttgccgacgatccagtcggcgatggcgtggggaatgttctcgttggccaggacgaagctgaacagcaccgcgttggtgatgatgtacagcagcatggccgacatggaggccgaggacagcaggatcttgcccacgcccttcagcggcatatccttgtagacgaacacggcgatcaggaaggcgtagacggcgctcatggccgccgcctcggtgggggtgaagacaccggtatagatgccaccgatgacgatgacgatcagggccaacccccagatggcctcgcggaacgcccggaaacgctgggcccaggtggcggggggcagacgaggatagtcgttcttccaggcgatgtaccaggtcaccgcgcccagcacggtggccagcaccaggccgggaatgacgccggccatgaacagggcgcccaccgaggtgttggtggccaccgcgtacatgaccatcaccagcgagggcgggatcaggatgcccagcgcgcccgaggtggtgatgacgcccgccccgaacttgttggggaagccctgcttgaccatggcgggcaggatgatggagccgatggccaccaccgtggccgggctcgatcccgacacggcggcgaacagggcgcaggccatgacgccggccaggcccaggccgccgtaccagtggccgaccatggcggtggcgaagttgatcatgcgccgcgccacgccgccatgggtgaggaagttgccggccaggatgaagaacgggatcgccatgatctcgaacttctcgatgccggtgaacagcttcagcgccacggattcgatgggaacctgggtgaagaggaacagaaacgacaggacggtgaggcccagcgagatggaaatgggcatgccggtcagcatcagcacgatcagcagcccgaagatgacggcggagttcatggccgcttctccccctggtgatcacccttgtcgtctttggcgtccttggggtgaagattgtccgacatctcgaaccagttgatgtcctgggcggcgcgctggggatcggtggtgtcctcttccagcccttccacatggccgtggtcgtgatggggcagctcgccggtccggatgaagccgacgcagacctgcaggaagcggaagcacatcagggccgagcccagcggaatggccgaatagaccacccaggtgggggcctccatgtccggggtgatggggccttcgtagagatcgccggtgggcaggccgaaggcgtggaggaaggcgtaatgggcgccgttctccatgacgaaatggccgcccatggtggcgacgatgccggtgaacagcgcgccggccagcaggccgaatacgatcagcttggcccgccattggggatcgaggcggttgatgaccacgtcgacgcccacgtggatgccggtgcgtacgccataggcggcgccgaacttggccatccacacgaacatgatgatgcacagttcctgggcccaggaaaaatccaggtgcccgaccaggggatacagcagggcggtgcctgccgcatagcgttgcagaacggcgacgaagatgatcagcgtcgccgtgcccatgagaaaggcaatcagccattcttcaaggtgatcaagggctctcagcatggggcctcccacgaaagccgaaggattggaagcggacgagggacgaaggggcgcccaacacgccccttcgccatcagaccggaatcagttcttgaagccgaacttggcggcttccttgtagaacgattcgatcaggtccttgccgacccggccttccatgtccttgtgcacgggcagcagcgccttgcgccaggcctcgatctcggcggcggaggggtcatggaactcggtcttgcccgaagccttcatggccttcaccgcgtcgtcgttttcggtctgggcaatggcgttggcgaagacgctggcttcgctcatggcgccttccagggtggcccggatatcggccggcaggccttcccagaacttcttgttcacgatgaccgcatagccgagatagccatggttggtcatggtggcgtgcttttgtacctcgtgcatcttctgggtgtacatgttgctgggcgggttctcggtgccatcgaccacgccggtctgcagcgcctgatagacctcggagaaggccatgacctggggcagggcgccgagcgcgcgcatctcggcgtccagcaccttggaggactggatgcgcatcttgacgcccttgagatcgctgggggccttgatgggcttgttggcgctcatgatcttgaagccgttatcccaataggccaggccgatgatgcccttgccttccagcttcttcagcagactggcgcccaccgggccgccggtcaccgagcgcagcacgtccttgctggggaagatgtagggcaggtcgaagacctcgaattccttgacgcccagggggccgaacttggccaggctgggggccagcatctggacggcgcccaattgcagggcctccatctcctccttgtccttgtagagctggctgttggggtagacctcgaccttgacgcggcccttggtccgctcctcggccagcttcttgaagtactcggcccccttgcccttgggggtgtccggagcgaccacgtggctgaacttgatgacgatcggctgtgcctgctgcgccatggcgctgccggcgagaacgcaggcggcgatggcccccgcgatgagggttcccaacttcatgatatttcctcccaagtcgcctgttgcccaggctattccacactactataggaatcgcggcgcagctcggccattgtggtgttccacaccggtaccaaggtcctatgaacgcaccccgatccctcagagaccgtcaggccatccaggcgatgcccgtcattgccatggggctggtggtcatgctgctgggcgtcctgctgtggctgctgcaccgtaacgaggtggaggaggagcggcgagccctgatccaggacatcctgtgggtcgagcagaacctttacttccatctgtcgtccggggtcgagcggctggggcagctggccgagatggccgggcgcgacggcccctggtccgacgagttcgtcctgcagggcaaggcactggtcaccgcggctcccgagatcgaacgggtgatcgtccgcgacggcatcggcgcggtggtccagtccctgccgccggtggaaagcggggcggccctgggcggcgattccgagtgggccaacaccttcgccctgtcccgctcctcgggccgtccggtttatggcccgccctacaccgtggagggcaagggggcgcgcttcgaggcgcaggtacccattttccgcggcggacggttcgccggaaccgtggccggggtgttctcgctggacgccatgctggccaatcgcgtgccgtggtggttcgcccaggcctaccggctggaaatccaggacggcaacggcaccttgctggccgccaagtcccagctgtcgcccgccgagcccggggccagctacacgctgcgcttcgagccccccggccacgggctggagctggtggccatctcctaccacagcgacccgcaactgctgcgcaacgtgctggcggcggccatcttcatcctgtccatcctgtcggtctccagcctgtgggcgctgcgccgccatgtgcgccgccgtctggccgccgaacaggcgctcaggaccgagcattccttcaggaaggccatggaggattcgctgaccgtgggcatgcgcgcccgggacctggagggccgcatcacctatgtcaatccggccttctgccacatggtgggctggaccgccgacgaactggtgggcacggtgccgcccatgctctactgggtgcccgaggatctggagcatacctacgagctgcatcgggcggtgatgcgcggcgaggcgccggccgagggtttcgaactggtgttccggcgcaagaacggcgaacgcttcagcgccctgatctacgaggcgccgctgatcgattccgatgggcgccacaccggctggatggcttcggtgctcgacatcaccgagcgcaagcgggccgaggagctgtcgcgccagcatcaggaaaagctgcagcatacggcgcggctgatcaccatgggcgagatggcctcgaccctggcccacgagctgaaccagccgctgtcggccatcgcctcctatgccacggggtgcctcaaccggctgtccgccggcgatgcccggcccgaggaactggtgccgccgctcaccaagctgggggcgcaggcccagcgggccggacagatcatccgccgcattcacgatttcgtgcgcaagagcgagcccctggtggtgccctgcctgctggacgagatcatcgagggcgtggtgggctttctcgaacccgatgcccgcaagcgcggcatccgcatcgacctggacctcagcctgaccccgggcgccgcccggccgcgggtcgaggccgatcacatcctgatcgagcaggtcatccttaacctggtgcgcaacgcaatggaggccatgggccacacaccgaggccgcaacgccgcctgaccatctcgttgcaatgcgcggacgggcaggccagaattcgcgtcgccgaccggggaacggggattcctcccgaaatcgccgccaatctgttcagtccgttcttcaccaccaaggaaacgggaatgggaatggggctgaatatttgccgctctatcgtcgaggcccatcggggccatctgtggttcgaggagaatccgggcggcggcagcgttttcctcttcaccttgccggagatggctggatgagcaaaggcgtagtctatatcgtcgatgacgacgaggcgattcgggacgcgctgggctggctgttccagtcgcgcggcgtcaccgcccagtgcttcgcctcggccgaggacttcctgtcggtctggagcgtgccgtgcagcggctgcttggtgctcgacatccgcatggacggcatgacggggttggaactgttcgaccgcttgtgcgagatgggggccaagctgccggtgatcttcctgaccggtcacggcgacgttcccatggcggtctccgccctgaagaagggagcccgcgacttcgtcgagaagccgttcaacgataatgatctggtcgacaaggtgatcgaggccctggcctgggaggccgagcgcgtcgcctcggccgccgacgccgcctcgctggcccagcgcctggaaagcctgacgctgcgcgaacgccaggtcatggacaaggtgctggccggcaagctcaacaaggtcatcgccgatgacctgggcatcaccatgcgcacggtcgaggtccacagggcccatcttttcgagaagatgggcgtcaagacggcggtcgaactggcccagattctttcccagcgccgctgacggtcggcgcgggtttacaagtggcccggtgtggttcatcttctctcgcgggtggccttgtgcccaacccattgatggaattgccttaacaaggacaggtcggtcatgacggcggctcacgagatttacgtggtggatgacgatcccgcggtgcgggactcgctgcgcatgctgctggaggccggcgggcacgccgttcgcgcctatcccgatgccgagagcttcatcgccgagggaatgacgggcaccggccccggttgtgtggtcgccgacgtccgcatgcccggcctcagcggtctcgacctgctgcgcatcctccaggatcgcgacatcgacctgccgctgatcgtcatcaccggccatgccgatgtcagcatggcggtccaggccctgaaggaaggggcctgcgactttatcgagaagcccttcgacgattccgtgttcatggccgcggtgaccaaggcgctgtcccgcagcgaacgcgcctgggtcgagcgccgccgcctggacggcatcgaggcgcgggccaattcactgacgccgcgtgaatacgaggtgatggtgctggtggcccagggcctgtccaataaggccgccgcccaggagctggggatcagcgtgcggaccgtcgaaattcaccgtgcccgcgtcatggagaagatggccgccgacagcctgtcggccctggtccgcatggtgctggagctggaggaatcggggcgtctggtccatgacgaggattccgccccggtctgaaggctgcgaaacatagccgtcccaaattgaaaggggcgccggtttgcaccggcgccccttcgtttgaccagaaagcggaaacgcaacactgtgcggtcgcatctccctgccaaggagggtggggatgggcgggaaggccccccagggcagtatctccggttctggccttcgggggctttcgcccctgtccagctcacgaagtaactgtagcaaagtattcgcaaggtgaaaacaggaaaatcacccgctcaatttgatgcaatggttgcgctaactacgcctatatttaaaaaggtatttaggtaaaattttatctaaatccgtcgggtcgttaatttccaggctatcaggcgttgctcactgtagcgcttccggtgttgcgccattcaaaaacgggcggcggaagcggccaaggagggatagcgacctaggtatattgtcctcgcttgtctcggcggttccgtcggggcaccatggggccttcaacgatgagggggtatggcatgcttcgggctgtcctggtgatgatcctgatcctgcagggcctttcggcgacggccagggccgaggctgtgatctttggcgcctcgcggctggaggtgatcacccagggcggcaagcggcatgccttcgccgtggaactggccacgacgcccgagcaattgtcccagggtctgatgttccgccgcgatcttcccgccggcaacgggatgttgttcgacttcggcctccctcgccaggttgccatgtggatgaaaaacaccctgatccccttggatatgctgttcatggacaggactgggcgggtgatccatgtggagcaatacaccgtgcccggcagcctcgagccgcgcggtccgtcagaaccggtgcttggcgtgctggaacttcccgccgggacggtacggcggctggggctttcggccggcgaccgggtttcccatcccatgttcgagcgggggcgctgaagccgccttgcgcttcggcgccaaaccccttactttccgccgcacggggcgtagctcagcctggtagagcgccagctttgggagctggatgtcggaggttcgaatcctctcgccccgaccacttcctagagaaagaccttgttggccggccagtcgcagggctggaccatgcccggccggctgccgccgaacgggatgccggagaacagggaaaagcccagcgacacggcgcgcttgatgtcctggcctgacgaggcgttccacagggccagatccagtccgctgcccttgacctcgtgggccaccacggccagcagggcgtagagggccgaatgggtgaaggccgccgatttggcctgggcctcgttgaagcacagatagctgacgccgcaatccttgaggaaacgggccaagtcgggctcggggaagatgcgcacgccgacgctggcgccgcccgccagcagggcgcggatgacgtcgcgcagccgcgtccggctggccgagccgacggcgccggtcaattccaccatcagcccgccggggcagaaggcgccgaccctctggatatcggcggtgaccacggcgcaatcggtcatggcgtgatcgttgaggacctggggcatgaccaccagaccggggctgaccgccgccgccgccgccgcgtgccgcaactggatattgcgatcccgggccagcgggtcctgctcgccggccagttggacggcgtcgtctagcaattcatgcccctgaaacaggcgcttggtcatggcccggttgccgatgatcgcctgccgccccgcgtcccaaagcggctggaacaccacctgaagggggacgccggtgtgatgctcgtggatatccagcacggtttccatggcgggcagggcggcggcggcggggcgggggcgcaggcggtccaggggcaggacctggacggtgacgttgatgtggccggaagactttccgaacagccgctctctgatctcgcgcgagatggcggtggccttgaccatgccctctgtgtcgctgaggccgggaaagaccagcatgtacttgcctggctcgagggggacgcaggcatcctcggagcccaggcgatgctgaatgatgtgctcggcgatggacagggccttgggcagcgagcccttcagggcggaatcatcgccttcggccagcacgctgaccagatggatgcggccgaagctgccctgtccaccccggtcgagcatggtccggataagggcctcgaaggcctcgcgatcggtgaagtgttccgccatggtggttcggcccctacggcatgttcccgggatgatatccgagcggctaagcctgggatatacgactcaataccaatgaaaggggtgcttgccgcctgggcaggccgtgccctgaatttgggcgatcgtcggtcagcgggcggaaaagtccccggaattctcctggcccgttccttgcgtcgggcttgggctcaatgggatgcatcgagggggatgtcgtgagctattgtcttgggatgcggctgaaggccggtctggtgttcgtttcggattcgcgcaccaatgccggggtggacagtgtcgccaccttcaagaagtcctacgtcttcgacggagccgaggatcgggtgatcgtcatccttaccgccggcaatctggccatcacccagtcggtgatcagcctgctggaggaacgccttcatggccccgaccgctcgcgctcgctctatggcgtcaagtccatgtacgaggtggctcgtctggtgggcgataccctgcgcgaagtccacgccatcgacggcgcccatctgaaatcccatggcgccgatttcatcgcctcgctgatcgtcggcgggcagatccagggacggcgcatgcggctgttcaacgtctacgccgccggcaatttcatcgaggcctcggacgagaccccctatttccagatcggcgagaccaaatacggcaagcccatcatcgagcgggtgatcaccgtcgacacctcgctggaggaggcgaccaagtgtgccctggtctccttcgactcgaccatcaagagcaacatctcggtggcgccgcccctcgacgtcactctggtgcccgccgatggttgccgcgcctcggtgcgctaccgcgtcgccgacgacgatccctatttccagatggtgcgccgcgcctggggcgaggggctgcgcaagctgttcacccagctgcccgatccggactgggcggggggctgagcgggaccggggcgtccgccccgcgccccgaccgggagttaggtctcccggaccctcttttcatttcataaggcgagaccagatcccgatgagtgaaactcattgggatctggttaggcccaaggggccgcgccgacgccggctttgccggcaatatttcggcagcacgccttcgcgtgtaggcccgcccgccgattgagggcggtgaaagaaagggaggttcggaggttctcctccgagcgggcttgggcggccgcccaaattcctcagttcgccttggcctgtaccggcttgcccggattggatgccacatgcgcgcccgaggggatctgggccatcagcaggtcggtggcgcgcttgtgcgcctgatagcggtccatgtcgcgccccgccagcttgatcccggtgggcaccttgatggacagcgggttgacctggttgttgccctgcagcacctcgtaatggaggtgcgggccggtggagcggccggtggagccgacaaagccgatgatctggccttgcatgatgcgccggccggtgtgaacgccctgggcgatgcgctgcatgtgggcataggcggtggaaaagccgttgccgtggcgaatgcgcacataattgccataggcgccgttgggtccggccatgtccaccgagccgtcgccagccgccatgatgggggtgccggggggcacgccgaaatccacgcccttgtgcatcttggaaaagccgagaatggggtggtggcgcagcccgaagcccgaggtgatcttggcgccgtccacaggggtcttcagcagggccttcttggcgctctcgcccttgccgttgaagaagtccgaggcgcccgatccgtcctcgaagcggtaaagcgtgacctcggccccggacaggtcgaggccggcatagagaatgtcgccactcttcaccagcttgcccttggtgtcgtaccagccgtcgaacagcacctcgaagctgtcgcccgcctggatgtcgcgctggaagtcgacgtcatagctgagcacccggatcatgttgatgatcgcttgggcggggatgccggcggcggtggcgctctcgaacaggctcgacttgatcttgcccgagaagtgggcgacctggcgggtgacctggcgcctttcctcgcgaccgatgaagccgcccttgggattgcgccgcacctggatctcgcggatcgggtcggcggccagccccacctgggagaaggggccctggccgaagccccagggcgacggatcgaaggtgacggtgaccttctgcccggctttcaggtcgcgggggtcgaagaccttgaccagggcctcgatgacctgggaggtgtcggccgaagggatgcccgcccgacccagaaggctggccagcgtctcgcccgagccgacctgcaggacatggtccaccggtcggccggagcggtcttccagttcgccgtcgctcagctcgggcgagggctgggcgctgccctcgctctccatatccacataagaggggggagcggaatccaacgtgccgccctcctccccaaaaggcgagaacgacacataggggcgcgagaccatgaccgccacacccgccaccacaagggcgatggccagggccttcaggctgcgcagcagtttggcggtgacgagggcggccaaggaagtcgctcatcccataataaggtctggctgggttatggcagccccctccaccccaaggcaaccccaaatccccccttcttatagaggggggctccaatcggcctttttcgcacctgcgaaaaagaggggttgacggggggagggggacggcgtagaacccgcccctcgctgccggagaccctggtgttttcggcggtggaacggcccggtcagcgggatttgccttcgggtaaaaacagtggttgacagggtcggatggggcgggtagaacccgcctcccgctgcgacggaccttcgggtttggagcggtggaacggcccggtcaacggggtttgccttcgggtaaaaacagtggttgacagggtcggatggggcgggtagaacccgcctcccgctgcgacggaccttcgggtttggagcggtggaacggcccggtcaacggggtttgccttcgggtaaaaacagtggttgacagggtcggatggggcgagtaaaacccgcccctcgctgcgacggaccgaaagggacggggcggcaaaaaggaccgggtcaacggtttccgcctccgggcgaaaatgaagtgttgacaaggatttacgggtcgggtagaaaccggcctccccgctgcggcggggccttcgccgagacgaaggatcggagatcggaaacggtttcctgctgttttacaagtgaagagacaggaagggatgcgcaggcggcgtcggtgccgaaatctggagccgactaaagcttgaacatcctaagctatgcgtagaatgttttgctttggacgagctctatttcctcggatcttcggatcgcttggaagtcaacttgagagtttgatcctggctcagaacgaacgctggcggcaggcttaacacatgcaagtcgaacgaagtcttcggacttagtggcgcacgggtgagtaacacgtgggaatatacctcttggtggggaataacatcgggaaactgatgctaataccgcatacgcccttcgggggaaagatttatcgccgagagattagcccgcgtccgattagctagttggtgaggtaatggctcaccaaggcgacgatcggtagctggtctgagaggatgatcagccacactgggactgagacacggcccagactcctacgggaggcagcagtggggaatattggacaatgggcgaaagcctgatccagccatgccgcgtgagtgatgaaggccttagggttgtaaagctctttcacccacgacgatgatgacggtagtgggagaagaagccccggctaacttcgtgccagcagccgcggtaatacgaagggggctagcgttgttcggaattactgggcgtaaagcgcacgcaggcggtggtcatagtcagaagtgaaagccctgggctcaacccgggaattgcttttgatactggaccgctagaatcacggagagggtagtggaattccgagtgtagaggtgaaattcgtagatattcggaagaacaccagtggcgaaggcgactacctggccgtcgattgacgctcatgtgcgaaagcgtggggagcaaacaggattagataccctggtagtccacgccgtaaacgatgagtgctagttgttggggtgcatgcacctcagtgacgcagctaacgcgttaagcactccgcctggggagtacggccgcaaggttaaaactcaaaggaattgacgggggcccgcacaagcggtggagcatgtggtttaattcgaagcaacgcgcagaaccttaccagcccttgacatgggacgtatgtttgccagagatggtgacttgtcttcggacgcgtccacacaggtgctgcatggctgtcgtcagctcgtgtcgtgagatgttgggttaagtcccgcaacgagcgcaaccctcatcttcagttgccatcatttagttgggcactctgaagaaactgccggtgacaagccggaggaaggtggggatgacgtcaagtcctcatggcccttacgggctgggctacacacgtgctacaatggtggtgacagtgggtcgctaactcgcgagagtatgctaatccctaaaagccatctcagttcggattgcactctgcaactcgagtgcatgaagtcggaatcgctagtaatcgtggatcagcatgccacggtgaatacgttcccgggccttgtacacaccgcccgtcacaccatgggagttggctttacccgaagccggtgcgctaaccgcaaggaggcagccgaccacggtaaggtcagcgactggggtgaagtcgtaacaaggtagccgtaggggaacctgcggctggatcacctcctttcaaggatgtccctcagatcttcgctcacacgggatctatcggacgtaccttacacacggctcggcgccgtcttcgcatcccttcctcgaatgaaaccgatactcgggctcgtagctcagctggtcagagcacacgcttgataagcgtggggtcgtaagttcaaatcttaccgggcccaccatatctgaccctctggtcgcgcatactccgagctggttcccaatcaggggccatagctcagttgggagagcgcgtgctttgcaagcatgaggtcgtcggttcgatcccgtctggctccaccaaattggtgtcgagcccccaggattttcattcgaggttgtctcaagagattcgcccggaactgcggttcacgggcctggtcgggccccccggggctccacccgctctttgtcatcgtgaataggtttttctgatctggcgtgcgccggatgctgctagtcaaggcagcgtgaaagcgcacactgaattagtatcttcgctgaacatcaagagtgtttcatgcgtcgggcttgtccctgcgtatggagcgatcaagcgtcaaaagggcatttcgtggatgccttggcactgagaggcgatgaaggacgtggcactctgcgaaaagccacggggagccgagagcaggctttgatccgtggatatccgaatggggaaaccccaccgtaaggtgatcccacactgaatacataggtgtgggaggcgaaccgggcgaactgaaacatctaagtagcccgaggaaaggacatcaaccgagactccgctagtagtggcgagcgaacgcggaccagcccagtgatgttgtgtacataatctgaaccgtctggaaagtcgggccatagagcgtgatagccgcttaagagtaaaccgcacagcatcctcgagtaaggcgggacacgtgaaatcctgtctgaacatggggggaccaccctccaaggctaagtactcctcagtgaccgatagcgaactagtaccgtgagggaaaggtgaaaagcaccccgacaaggggagtgaaatagtacctgaaacggaatgcctacaagcagtcggagcccccttgaggggtgacggcgtaccttttgtataatgggtcagcgagttagtgtatgcagcaagcttaagccggtaggcgtaggcgcagcgaaagcgagtctgaatagggcgacgagttgcatgcattagacccgaaaccgggtgatctagccatgggcaggttgaaggtggggtaacacccactggaggaccgaactcacgtctgttgaaaaagacggagatgacctgtggttaggggtgaaaggccaatcaaactcggaaatagctggttctccgcgaaagctatttaggtagcgcctcggacgaatacctacgggggtagagcactggatgggctagggggtcccaaagacctaccaaacctaaccaaactccgaataccgtagagtaatatccgggagacagacggtgggtgctaaggtccatcgtcaaaagggaaacagcccagaccgccagctaaggtccccaagtcatggttaagtgggaaaggatgtaagacggccaaaacaaccaggaggttggcttagaagcagccatcctttaaagaaagcgtaatagctcactggtctaatagctgtctcgcgccgaaaatgtaccggggctcaaaccatgcaccgaagctgcgggtgtgcactatgtgcacgcggtagcggagcgttccgtaagcctgcgaaggcgtcatcgtgagaggcgctggaggtatcggaagtgagaatgctgacatgagtagcgacaaacagtgtgagaaacactgtcgccgaaagtccaagggttcctgcgcaaggctaatccgcgcagggtaagccggcccctaaggcgagggcgaaagccgtagtcgatgggaaccacgttaatattcgtgggcctgctggaagtgacgacccccgtgtatcgtatctccttatcggattggaggtgcggtgaagggggtccaggaaataactccagcgtatagaccgtaccctaaaccgacacaggtggactggtagagtataccaaggcgcttgagagaacgatgttgaaggaactaggcaaattgaccccgtaacttcgggataaggggtacctctctttgcgcaagcagaggggggtggcacagaccagggggtggcgactgtttactaaaaacacagggctctgcgaagtcgaaagacgacgtatagggtctgacgcctgcccggtgccggaaggttaaaaggaggggtgcaagctctgaattgaagccccggtaaacggcggccgtaactataacggtcctaaggtagcgaaattccttgtcgggtaagttccgacctgcacgaatggcgtaacgacttccccgctgtctccaacatcgactcagcgaaattgaattctccgtgaagatgcggagtacccgtggctagacggaaagaccccgtgcacctttactacagctttgcagtggtactaggatgtggatgtgtaggataggtgggagcctatgaagcaccggcgccagctggtgtggaggcaaccttgaaataccacccttctgcttcctggtatctaaccgcgccccgtgaacccggggccgggaccctgcatggcgggtagtttgactggggcggtcgcctcccaaagagtaacggaggcgcgcgatggtgggctcaggctggtcggaaatcagctgtcgagtgcaatggcataagcccgcctgactgcgagacaaacaagtcgagcagagacgaaagtcggtcatagtgatccggtggtcccgcgtggaagggccatcgctcaacggataaaaggtacgccggggataacaggctgatctcccccaagagtccacatcgacggggaggtttggcacctcgatgtcggctcatcacatcctggggctggagcaggtcccaagggttcggctgttcgccgattaaagtggtacgtgagctgggtttagaacgtcgtgagacagttcggtccctatctaccatgggtgttggaaacttgagaggacctgtccctagtacgagaggaccgggatggacatacctctagtgtaccggttgtcgcgccagcggcatcgccgggtagccatgtatggacgagataaccgctgaatgcatctaagcgggaagctcccctcaaaaccaggtttccctatcagagccgtggaagaccaccacgttgataggcagcatgtggaagcgtggtaacacgtgaagctaagctgtactaatcgctcgatcggcttgatcgcccatgcgtagcggcaagcccgacacaagaaacactcgcatatgtgcacgaaggtactaatccagatcagaaattcttcttcgtttccttcgacgaccaggtggtcatagcgagggccccccacccgatcccatcccgaactcggacgtgaaacccctctgcgccgatggtactgtgtcttaaggcacgggagagtaggacgctgcctggtcttcaaaggaaacgaaaaaagaaaaacctaacacgatcgacaaacaccggccctcataaggccggtgtacgcctttctaaggccttatcacggccaacgccttaccgcggggtggagcagcccggtagctcgtcaggctcataacctgaaggtcgcaggttcaaatcctgcccccgcaaccagtccaaaaagcctgcaatcccaacggattgcaggctttttctttgggcattcgaatggggcaaatatcacgctctgctccaattttgctccattgggaatggttttgcagtattcatgatccgttccaatttggtcctatcgacaacttgacgaccccgatgccatccttttggtacggagtttttgtcatggcggattttatcaagcgcgttggaacgaacgggaagatcagctggcaggccagggtccgccgcaagggcttcccggatatgttcaagacatttcggaccaaggtcgaggctcaaaagtgggccgcggttacggagtccgagatggcccgtcacgtcttcaccgatcgcagtttggccgagcgcaccaccctgggagatgcccttgaggtctatcgggacgaggtgacggtggagaaggccggccatcaagaaggctatgtgatcaaggcttggctcaagcatcccttgtccaagcggactctttccagcttgaaggtccgggatttccaggcatgggtgacggagaagaaggcaacggttgggccgaagaccatccgccttcatatcggcgtcatttccaatctctataatcggcttgagaacctgctcgagattgaagccctgcccaatccggtcctgaagcttatcctccctccgttgccagaaggtcgtgatcgccgcctcaatgttatcgagcatgatgacggcaccgtcaggaatgaagccgaggctctcattggcgcttgtgctgatgccgtcaatccctggattcgccccgccgtggaatttgccctcgacggcgcaatgcggcgcaacgagatcgtccaaatgcggtgggagcatgtggatctcaatgctggaatggtccggttaccggccgccatcacaaagaccggcgtttctcgtgatgttgccctcagtcctgccggtgtacaggttcttcgcacccttccacggtcaatcgacggcagggtttttccgctgactgccgatgccctctatcgggccttcgttcgggcccggaagagggccgggcttgacgatctccacttccacgatcttcggcatgaggccgccagccgtctgcgggaagagggactcgacctcatggaaatcgcgtccattaccggccacaagacccttcagatgctgaagcgctatgtccacgtaaaggccaaggatgtcgtggaaaagcggcagaagtcccatggaggcagccatggatgatgaccacgcatcaggggtggacccgggtctagacccgggtctagacccacccagctcgtgttgtcatgggaaaattagaccgtcagatttcgctgatgtgctggtcaatatggccgcgcatcaggcaatgacatcgtcaccggacgtaagggatgattccctggctccgccgctctccaatgccgacttggcaaggggagggctttgtcgcgcagacgcgtggatcaggccggaaaagtccgcgaatgcaaggcgtatggagcgcaagcactgcaagctggaagattctgggcttcggcaggtgaacatcgtcgctccgatagcatttcatgacgtcatgaagggaatcgggcgacggatgaaggctggggaggacccagtcggggtaatgctcgacgtaatcgtcggcggggctgtctctcaggaaggtcgtgagctcattttggaactgatccgtcgcgtggaaaacggagatctggaaattgggcgactcaagcagctgctgaaatagccatgggattatcggcatcggccgtggtggagccgcaggcggcggcgactgccaatatcagatcctgcttgttcatgaattcctcccctattcaacatgacgggcaccccgtcaatgatggtggtgctgaggcgggagtattgatgcgtggacttcagagagggaaagaaaacaattatttccggcaaacatatcgccgatatgtcggtgagagggaaagtaaacagatatatcatgacatccgctattcactaggtatcccatcatgaccgatccggcatcagatccagactccgaccttgattccattgccattacctctgagcaaatcaattgcctcatcgcggggctggcggccgttgccggtcaatgcgacacggctaagtctcttgatggcgaaggcttcgccaagatcgatgttcctctcggccatatgcttgcgcagttgccagcggcggagtggtcggaggagaacattattagcggcttgattatggctaagcgttacaggcgccagatctcagctgcaggggtccagctcgataaactgctcgagttgtccgtcaccgcgatagccatccggaattcaaggcgggctacacgcaaaatgaggaagcgtggggggagtgtcggtattgaggttaatggcgatagtcggcgcattacaatgatctcgcctttcaaccattacttagttcaatggcagcgcgaactgatcggcgaccaatggctcgaagataagcggatgcgggtctgtttgttttgcctggaaaacgccattgcggttatgaaattggctgccgaatttgggctgacgctgcctgacgattgggagaaagcaatcgtcgatgcaaggcctgttcggcgttttgagattgttgggcctagtgtcattcttcacggcgcatctcgccgcgatattccagataatagatgggaggacggacttgatagcgactacaagctgtttcgcctggattatgaaaagggccgatgcatcatcacttcggccgcgagcagttgggcgttgcgtcggctccatggtctgctggaccagcgtggctatcgcgaccagataggtttctcaaatttgatgcggcggataccctccctggtgagggaagaaaaccggcgcgctgaatccgccggtgcgctgacgccaatcaacggccagccgatcctggaggggctgccctcggcaacagcggcacggattaagccacaccagatcgttggtatcgaacagatactaaaggggggcgtcgcgggcgccggcaacagtgagatcatccttgccgatgagcaggggctgggcaagacgttgaccgccctggcggcattggagatcgccgacgcctggccagcggtgatcattactcccgccgtagctaaattaaattgggccgacgaggcggccgactggctgccccatcgtcgtattcatgtgattggcgttggcgccagagcagcgggagtgccactctccgatgccgagatcatcatccttaactatgaggtgactaaggccaatttggatgccctcatcgccatccagccgcaggcattggtgtgcgacgaagcgcagtacctcaagacctacaattccgcccgaaccgaagcggttaaggcgctgctggaaaaaacaaagccgacgatccggttgttgatgaccggcacgccgattatcaacaagccacgagaattgctgacgctgctgaccttgctgccggtcagtctcggagccatgggcggtttctggcacttcgcggttcggtactgtggcgccaagaggcgtcgaattggctatggtagcgaattcattgatttcagcggcgccgagaacaccgaggagttagccgaccgggtccggcgggtttgtctgctgcgaagggaaaagaaacaggttttgcctgatcttgcggataagctctggtgtcaggcggatgtcggtttggcaaaccgttacgaatacgatgatgccaaccgcaatctgatgacgtggatgacacagtaccgccctcagcaagcagaagacattcttgaggctaggcgagctcgtcatcgagctctattggccgagcttgatgcccttgaagccagcggcgatgatgacgaagatgaaatgtatttgctcgtcaatcagatcagcctgttggagtttggtctgggtgaactcggccaggccgacctggatgaagcgttgcgcagggtcagtgtgcttcgacagcttaccggcattggcaagattcccgccgcggtgacctgggtggaacacttcctcgtctcaaaaccctcggaaaaattgattattttcgctcaccacatcgaggtgcagcaacaattgcaggtggccttctccgacgcccttgtcattgatggcaagacttcggcaaccgctcggcgcaaggcggtcaaagccttccaggctgagggcggtccccgactgatcatttgttccctgcgcgcggcacagacggcgctgactctcactcgcgcccgccacgttctgttcgtcgaactcgattggacgccatctgggattgagcaggcggctgatcgcgcacaccgcattggccaggacggccaagttgagatcacgctgatggtggcgcctggttccctggacgaccgcatgttggaagtcatcaccagaaagcgagtgataatccgttccgttatggcgaacgacaccgccagcatggcggcacctttcggccttcgccgggatggactgccgcgtatgcaagccgcggggcctggtcgacctaaaacgctcagtgaagaggaaagaaaacagagaaatgctgctgctaaagccgcatggcgggaacgcaatcgaggtaaaatgcagggctacaccaagctgtggcgggcaaaaaagcgggtgtgagcgaaggaggcgtctaggtttccggcccagccggtggcagcttggcaggcgaccgcagtgcccccgggaacggccactcggctggagcatccgctatggcccctgagtgccacaagccgtcatttacttgccctgttgggggctgtcggcttttggcatgggcagtaccagctgatgtgctagtctaaatccgtatggctatctgccatttgggggggatgatgcctatacttctgatcgtgctgtcagcttgtggtttctttgccgtcatggttggcgtgtccaaactggctgatcgaaccaaggtgaagccagccgccaagggtgcccgaaccataaactttcagggcatcgatgatgctggaaagctgacccgacagaaggcggagcttgaatctcgggttaaagcgcttgctgccaaggaggcatcccttatcgcttccatgcaggaattcgagcaaggcatcgatgcccgcaagggggcgaagctggctgccgagcaagacgaaatcaatgctgctgtctcggccaaaaatgcagttgaggctcgtgttagcgagcttcgtgaggctgaacgaaagctggccgatgtcgtctctgaccatcaggccgacgccgaccgtaagaaattgcatgtggatgaactatccgccgacgttgccgatctcacccggaccaaggacgctctcgacgagagcatcaccaatctcttggcccggcagcgtgagattgaggctgagatggccgaactggatcgtgacattgacgagcgacgccgggaaaaagtagccgagatggaagaggccatcgccgcacagaaggaattggcgctgtccaagatcatggcgtggacggaatccgagaaatcgcggcttcaggagcggttcgagagcagctatcagaccgaggtcaccgacctgcggcgtcagctgatcgagaaagtcaccgccgaattcgacagcatccacgaatacttttcggcctttgcctcggagcgcaagctcatggccgagaccgagatcaaggacttcctggcggagaagcgttcgaccattctgtccaacctcgaatagaccggagacggacatgcttgctcgcgccattctggctgtcgccctgattgtcagtgctgttcttggcccggttcgtccagtttcagcccaagagcaaccggacattatcatcctgttcgatcaatcgggatcggttggaaagcatgatccaaaactcgcctccaaggcctggctgcttaccttcctgaagaccttcgacaatccgtataagatcgaaatcgttgggttcgacgaagccctgtaccgtcacctggccatcgaccgtgataccgccaccgacatcaatgccgtgaaccgggccatcgacggcattgaaacggttggcaaggcgacagatttggagatgccctttcgctatctgctgaatttcgcaaaatcctcgacgaaactggccgtgattatatccgatggcgagcctgagatttgggatgccaagctgggctatctcagcaaggaggttcaagcggattcccgctatgacgatctgaaccgtcagtatcaacagatgaaggatgccggggtctctaaacgcaaacgatttgaaaagctcggtgccttgtaccacgcccgcaatatcgatctgatcgaaggccagatgcccggcatcgcgaagctgatcggggatcgactgatcatttgggatttgtcggggacatcatactatctgaagacctgggccaaggcggcgggtgcccaatatctgccgatgcgggtggctgctcaggaaaaccccgttgagcaattgcagaaggcaatgacggccttgcagcagcattccagtgctatcgtcaaagaggctctacctgacgaccatgagcaccgggcggcagtcgccttgaccacaattcccgagatcgctgcgaaggttcagcccaaggagattccagcccccaggccgccagctccacccgttgaaacgaaagcaccagaacctgcaccactacaacccgtggctccgtcaccttcaaaagatgaccagccctcatcctggttgatcgtgctggtgctactgggaggagccgccggggcttatgctttcttccgtcggcgagcgccggtcgcgtcgtcggccaaggctggacccgccatacccttggaccttgcatctcagtacatcgacgccaaggtcaagaatgctctcgatgatgcggagaaactgcggcgtaagcttctcgtcaatgagagcggggcggtcaatgtcgagcgacggttctcattgcgcgtatctgttccgcccggagccatggaggttcaatggatcggtgaggatggtgacaagcgggaaacccccgcaatcgacatctccatgcatggcgtcaaattcgagacatatggagccgggatagcctcggtcaccgcaatcgtctgtccgaagatggaggtggtgctggccgtgaagaaatttgaggaaatccgccgtgatggaagccgcgctgtagcactgctgatcgagttcgataacaatctcgacgactggatgcggtgggtggaaatcatcacccggattgatcaggctgttacgaagtgattggaccacgccctatagctgtggcccccaaacaggagatttccatgagcaatctgattgatgagactctggatttcgtggggcatgagcttcagattgctcgtgatcgggtcgaaggtctcgcccacgcactcagcatttctgtcctgccctctcccccggaaccaaagcagaagccaccaacactgaaacagtttcatgagcttgaaatgcgcctccatgagattgaggtcaagcttagggcaacccagcgcgagctagggctgaagaaagccgcaaacgaaggtctgatggcccaggcaaacgtcctaaaagacgcattgaaagcagcttaccctaaaagcccactgttgggatcgagtggtaaagcttggaaatctggaccgatggcgggaaagcaaaagtcccagttacgtgttgtctgggaaaaagcttttgacaaagaagccaagcgccttggggctaccgatcctctgaaaattcgcctttcctgaaccgggaaaagtttacacatcgaatgcctcttgtgggtcatggacggccgactggccccggcgcgatggatgactgctgcacctccgatagccgccgctcaaggcaaaggtccgatccggccccgttgtgccatttctcgtctgtggaccagttgatcaggttgggactgaaccttccggcagcgtaaagtagaaggtcgttccgtcgtcaggcatcgacgccagccaaatgcttccggaatgtcgctcaatgatcttcttgctgatcgcaaggccgatcccggtaccgtcgtattcttcacgtgcgtgcagacgctggaaaatgccaaagatgcgctcaaaatactccggcgcaatgccaatgccgttgtcgcccacactgaactcccaatgacggtccaggtgtcgaccgtcaatccggataatcggtgttacgtcaggctttcggtatttgagcgcgttgccgatcaggttctggaacagcctcatgacctgagtgggatctcccatcacccaggatgatcggatcgcgtcatcgacagtgatcgtcgccccgctgtctttgatcgccatccccagattagttagtgccaattgcaccgcaggcatgattggcatggcggtaatagcttcgccacatctattaacacgcgataattccagcagatcaagcaccagacggtctaaccgcttggccccatcgcgagcgaacccaataaattcccgcgcagcctcatcgagctgatccgaatagcgccgctccagcagactgagatagctgctgaccatccgcagcggttctcggaggtcatggctggcgacataaggatcgtgtcccaggagttggtgtaacagcgccttggccgtcatgatctccggcgggcatggccgggaccgtcattccgccgcgatgggcaggcagacgagaggatcatcgctcagttgggtgacggattccagggtcatgtagcgggagcgttggacggcccattcgtcgttctgctccagcaggatggcgccgatcaggcgggtgatggcggcttcgttggggaagattccgacgacctcggtgcagcggatcgctccgtcgtcggggcggcaggaccgataacggaccacccgccgggaaatccccacgatgcaacacgcccgacgctcactcagcccgaataactcccggacatgagcgacgacgctacgcctgacggcgggcgtcaccatttttttgaggaaatctctttcaaaacggcgttgtcgagcatcgcttcggcctgcagcttcttcagccgggcgttttcatcctccagcgccttcagccgcttggcctccgacacctccatgccgccgtacttcgccttccatttgtagaaagtggcgtccgagatcccgtgcttgcggcacacatcaaccatcttcgcaccggcctcctgctccttgaggatgccgatgatctgctcttccgtgaaacgactgcgcttcataagtccgtctcctgtcgtcgacgaactctacctcagaccggatacattttctgggaacaggtcagggtccatgacccaattgggtcattaggcgagacagcacttcacacgggctgcgccgtcaactccgggcaatccgcagtcatctgcgaacagattacggcaatttttaagcaagcaaagcggcttgtgtcctagatcgaacggacaaagcttttagtatgctcgttacatgaagcttcacagtgccctcagccagaccaagatctgtagctatttcccggttcgactttccagtctttaattggctgagaatctcacgctgcctcgaagtgaggtgagtaatattcggcacctcgactgtggcagtaaccagctgattaccgggatcggcaaactccgcaggaaggtaaatgccgccagccacaaccaagtttagcgccgccagaaaaacttggctggatgatgctttagtgatgaaacccgacgctccgaggtcgatagcaagattgacggcggaccggtcagcgacgtcagaaacgattacgatgtgcgctggcgacggaagcaaatgacgcaatttccttagacattcaggccaaggcccaccggacattgtcagatcgagcagagccaagtcgatgcccgattcacgctctcccgcctcaatgacttctgcgaaactgctcgcttccacaatttgcgaagcttccacgtacagggtgaggatgtgacgcagaccctcgcgaaacaactggtgatcatcggcaataaggatcttcatcggaaatgccaagcccacttttcacgccgttggctatatgagatccacgcccaaagtgtgcttcgattctgtctggaatgcacccgataatgcagatccacttgaaattcgggcacacactataaacacgcagttccatcatttggcgtgtcaacgggtctggatgagaacctcatcgatcttggtgaagccgctgccgactcccagttgagacagatggacggttaccgagccataaccatcgatcttcgccagccgcaccatggttcccgacttcgggacgtcgatgatgctgtccaccgaccaaaccgtccggctccgaccgttactctgataaagatcgccgagggcaacagctttcatgatccactccccttgggagcgtttcattgcatactgacgacggtctgatcaagtgacagattgaaaccaagattatgggatcagcccaacctgggggcatagcggtcacttgctgcgcggctgccaacgggctcaccgcgcgtcttgtctgccggtatcaattgcttgactgcgcttggagatagagcaaaattccttcaggggagcagtttcgccaattcggccccccgcgaggccgaccgggccgccttcgacagccacccggtcggccatctgcattttggaacactcatgcgtcactttggtctatctgcgcctccgccaattcgccgccgctccaagccatggtttgcgtggctggctgtgatggctgctattgcgggggtggtagcagtctgggtccgatagcgacactgacccggcatagcgggcgttcccgctgactggcggttgccggggcacagcggtcgcctgccgcgccggggccgaccagctcaggtttacactcaagggccgccgcaagcgttctcaccgaacgacgggtgtctggggtagagcggtcggccgcagcgtaccggctgaccggctcaggctgacccaacccggccatttggcaggaccgccgtccacatctacaggttgttagcccgaattgatctattgacgaggccaaaagaaacaccacaatctccatagggggcggtttcgccaattcggtccctcgcgaggccgaccgtgtagccttcgacagccacccggtcggtcatctgctttggatgtgggggcgttatggggtacgttggactatctgcgccgccgccagttcgtcgccgccccaagccttggtttgcatggctggcagtggctgccgctatcgctggtgtggtggcggtctgggtccggtaggggcctgcgtgatttatcgcgtgtcccccaataggtcgtctcatgacgaaatcaattttctatctctcgtttctgtatgcgggggggtgacgggtgaaactcgacatatccaccttgttcttcgttcttggtggagcgtcagttttggcgagcgcctttgcgtggttcctattcatcaacaacagggccatcaacggcgtcctggctgttgccctgtctaattcatttttcgccttcggcttcggggctatagcattgcgagaggtactgcccggatggctttcatttgttgcagggaatgtggccatattttgtggatatgcgctggttctttttggtcttctacagttcacaggaagaagggctgactggcgcttgctactgggtggcatggccatttacggctctgaatacgcttattatttttttattgatgacaattttaagatgcgactcttatgctatctactggcctactctgtgacatccctatgggccttcactgtgaccatctcagaatttcgtaagacccggatgacttcgtatctggctgcgtcagcattcttgctcttcctgtcgatttcattccttgtcagcgcggctctgtctaatcccagcgacagggttaaggacatctattcgctgacggcgatcaacgcatcggtagtgttcgagcagatcatctttgtcatcggctggatcatttcgtttatcttgatggttaacgaacgattgatcgacgaaaaaaatcaggttcaaaatgcactaaatgataaaaacataatattggagcagtcaaacgctgaccttgagcaatttgcctatgttgcatcacacgatctacagactccactaagtaatatggttcgatacgcccagctgcttgagcatcgatatagtgggaaaattgactcagatgctgacgatttccttcgctttattgctgaaggcgggaagcacatgaccaatttgatttacgatcttttggcattttcccgaacatcgcaacaattggagcttttaaggccgatacctgctggggatgccatagcacgggctttgaaaaatcttgaactggacctgcatgcatccggagcagaggtcacagtcggtgatctgccgacggttatcgccgatcagacccatctcgtcagtttgtttcagaacctactcagtaacgccatcaagtatagtgcgccagaccgcaggccggtgctttcggtgagtgcggaacgtatgcccagcaacgactggcgctttgctgtatccgataacggcattggtattgagtcgcaatatcacggcaagatcttcgagatatttcagcgtcttgaccctatgtcctacaaggatggcactggcatcggcctgacactttgtcggcgaattgtccaccgtttcggcggcgagatttggctagagtctgagctgggcgaaggcacgacgttcttcttcacgctcaaggatggtgcggaccaatcctgatcgcttcccaaggacgaccggttgtagcacatgggggctcttcgccgtgaacgacgggtgtctgggtagagcggtcggctgcagcgtaccggccgcccagctcaggctgacctatctcagacgtttcaacggtctgccgaagactgcggggcagtgtgtggcgttatgttaggaacgatcacctcatctgcgctcatgattcctcgagccttgcccgacatcttggcctgatacatgcgggcgtcggccagttcaatcagtgctggccagtcttgggcattatcggcgagcggggctgtcccaacaccaggcaagcccggcgctccgacaccgccaaccgctcgcacaccgccatgatgcaacaccggcgacgggcggggctcagaagtttccccaggcggcctccttcaaaatcagcttgtcgatggtcaggtcagccaccgccttgcgcagccgatcgttctcgcgctcaagctccttgagccgcttggcctgagagaccttcatccctccgtattcctggcgccagcggtagtacgtcacttccgtcaccgacagcgccttggcgacgtcggccaccttccggccttgcgccagaagcacgtccgcttcacgcagcttgccgatgatctcttcggcggtatgtctcttcttcggcatggaatgtccccttcatggtcagttgaattattacattcaacatggagccattcacggggggcaatccgtctatcgggctttggaaatagccggatgaatttccaaagctgataatgaggatacccctgaatttgcgtatcagcccagataagccattataggcatgctcaggatgagtccacgtaataatattgttattatatataattactatttaaggtgaaaagttaatgctcgagtctaaagcaatggagttaacagcgggtcgcgaaaataaaaatccttgtacataacgcacgccggcatcacgaagaacttttaattcttgagtccgctccactccctcggcgacaacatcaacgccaagctcctgacatacctttatcattcccagggcaattgtacggcgtcgttgatcatggtcgatattgcggaccagggcgatgtccaatttcacgacatcaacaatcatctctgccagcacattaagaccggcatagcccgccccaaaatcatcaagtgccaccctgaatccatggcggcggtattcctcgatgatgccaagcagatgaggggtatctgtgatcctttcgtcctcagtaatctcaaaggtaatgagatcgaggggaaagttgactcggtccgcagcagccaaggtggcacgtatacatgccttgggatcataaacggcattgggtaggaaattgatgctcagacgccggtccaagcccaagctggctgcaaggtcgatggccttgacccggcacgcctgatcgaatgcgtagcggttgtcggcagtcacttgagaaagaacgctcatagcaggttggccctctggacctctcaccagtgcttcgtaggtcgatatgcgtcgctcatgcaaatccacaattggctgaaacgccatggtgaaaggaatagcaaaaccctttccctccaggcacgagtggcaaccagattttgaatggctcatggcttccttggaccgttcgttcgcggcagcgtggatgatgcgagatttgctgtcgctttgctaattttctgccgcattttgaaccgtcaccaagaaactctgagtgacttttggggatggcagcgggtcaatgttcaggttcagcgtgcccgaaattagcgtctaattcctcgttgttagatgatgggggataacgcgttgctgtgcgagcaaaacttgtttccagccgctcgatccgcagaaaaagtttgtgtgaacgattcaatagtgatcgtaattcatcagaaattacagcatcattacaatgcgatgtgtccaagcacacatcatgcccagatagcctaaattggtcttccatcgcatattctgcggaaatctcaccgttatgaactgcacgctggaacatcagccacgacataacttgagtcagacggcttgttaaccgaaaagtttcattggttatccgaagccctttaacgccatcgactttttgccggtcccaccattcggtttccatcatgaaggtccgagcttcaaccagtagagccatggtttcttcaatagggccgcgaaaatatgcagttgtttgcatcctcgcacctcatgccaccaccaagacgggcgaatgtttcttacaatgctaacatgcgaagttccgccatcatatgccaatcaaaaccaaatgtcatacttcagcccagccagccatatacagtattgcggttatttcctgatagatggatctcgatcatcgtggttcaatcccctcgtggcttcttcccaagacgaacagccaccaccgatgtggatgccccccgcctttatccggccgtcgaacggttcctcggtcgagtgctcgccgtttcgaggccgctaaaccttcccatttagttaccttccaataatcgctattttgcgatatggtatgtccatggaatggaaggtcgaaaccctcaacgaaatcgtggacgcggaaatcgctgtcttgcccaaggatatgcaggcccgttttctgcggatagccgggatgattgagaccgctgggttggaaggtatggggcatcctcatgtgaagccgcttgagggcaagttatgggagatgcggctaatgggccgcgacggcatcgcccgtgccctctatgtgaccgtcactggtcggcgggtcgtggtagtgcgggcctttgtaaaaaagactcagaagacgcctcgccaggagattgaactcgcattggctcgggccaaggagattttgaaatgaccagcctgaatgatctcaaggctaaaatgctggctgatcccgaggttaaggccgaatatgaccgtctcgctcccgagttcgagattgcggaaacccttatccgtgcccggcaacgggcgggtctatctcaggccgaagtcgcaaaaaggatgggcaccacccagtccgtggttgcacggctggaaagtggtcgttcccttccttcatcgacttcactggcacgctacgccgccgccacaggaagccgccttcgtgttgagcttcttcctggtcgatgagtccactgctgttcctgcgttggctccgtcaccaagatggatgcgatcttgggttcatttatcaaattacgcaaaccgggcaacgatttcaccgcccaaggtttcctcgccaccttggctgaatgctccctggcttgatggacgggatcgctattggtcctcctgccgatcttctggtgtcagtggaaccccaagaagctcaaggcgatggccggtgacctgatagccgtaatctgcggcgatcttcttttgcaaagcttcaatctcaacgcaggagaattcgataacttcccctgaagttacgtcaatcaagtgatcatgatggtcactttcggcctcttcgtatcggctctttttcccatcgccaaaatcgtgccgttcaaggatgcctgcttcctcaaaaagtcgcacggtgcggtagacagtgggaatgctgatatgccgattgatctcgacggcacggcgataaacctcatcgacatcagggtggtcggttgcatctgaaaggacgcgagcgatgactcgccgctggtccgtcatcttcatagatttttcaatgcaacgctgctcgatacgagacgggggcgattcatccacggctcacttcctgtcgcatttcattcacctgaacaaaacacataccacaaaagaatgatgatgcaagttaatcgcaacgactgcgatttacaacttgatggctgagcggctgcccccggatgtaggcggttaccattgatctgattggctcgccacgggggaatgcgtcagattctcaatctcatttgcaggtgaccaaactttagcttacatacttatggtgcggatgtttcttgaatttttggagcctctcaatgcgggaccaattgcccaggaagaccatactgatcattgaggacaacgccctcagtttaaagctttttaatgacattcttcaggccagaggctactccaccctgcaagcaatggatggtcgcgaagccaaagagattgtcgagcagagccgcccaaatcttatccttttggatatccagttgccgggggtttccggcctagatttcgcccgcgtactgaaggaagacgctgaacttcaagcgatccctatcatcgcggtaaccgcgtttgctatgaagggtgacgaggagcgaatccttgaaagcggttgtgacgcctacctcgccaagcccatctcaattgaaaaattcctgaacaaggtgactgaatttttgggatagctatttctgccgtaaaggggggggcttccaggggaaagtaacggggatattggccaataccttgtaggcttatcgtcatgcggctttagtcatcgccttgccgtcccatcttccccagaaaatcgccaaaatccttggcttcgcggaagttccgatagacggaggcgtatcgcaaataggccacctgatccatccctatcagcacatccatgaccagttcgccgatgagcttggacggaacctcgttctctcccaagctctccaggcggcgatggatgccattgacgatgcgttcgatctgctcctcatccacgggacgttttcgcaaggcgatctggagcgatttaaccaccttgtcgcggtcaaaggtggaccggctgccgtccttcttgatcaccaccagatcgcggatttgcacccgctcggaagtggtgaagcgtgaggcacaggcaggacacgcccggcggcggcggatggaggcattgtcatcggtagggcgggaatctttcacctgggtgtcgtcatgtccgcaaaaaggacaacgcatactcgcccccccccatcgatgttcagattgatcattcaggaaatggtcgccgccagcaagaacagcggatgaccgagacaggaatttcaatccgcagcgtagacgtgccccggtggtcgtccggtgacgtgggctgggggccgtttacatattcgttgcgtgggccaacgatttgtaacgagcgggctatctggggtcgctacggattgaccttcccgttcgtgcggatgtaacgctcatggtggagtttctggaggccagatgtccaagcctctcaggaaacacgcggagttggcatctgtgatttgatacgcaggaacctgcaatgatggacgacgggcgaaatcagcatggaggtgaccagcatggaggtgaccagcatggaggtgaccaggatattgggcacctgctgaagctcgtcgaaatcccagaatacctgagcatgatccagccgatcattgaccacctcccatgtggggtggcggtgtttgatccgtccttgaacatggttgtctgcaatggggtgtttcggcgtctgctggacctccctgatgaactgttcacggcaggactaccatcattgaaaaagctcgccacgttcgccgctgaacgcggtgaatatggccctggcaatccagaggaacttgccgaacaggtcgtacagcgggccatggcaatggaaccgaaccagtttgagcgtgtccggcccgatgaaactatcttggaaatcgatgaacgtccgttgcccaatggcggattcgtaaccctttacacggacatcaccgaacgaagggctttggcagaacgcagccgtgatcttgaagccctcaatctggaactgacaaacaccgttgcggctctcgcagcatcaaatgccgaactccacgctgcacgggaagagcttgaacatctggcacagcgggatggcctgactggggcttggacccgtcgaagaattgaagaaaccgcccagcaggaaatgttgcgaaaggcgaggtacggccatcccgtatcgctcctcttcatcgacctcgaccattttaagcgggtgaatgacacccacggccatgcggttggtgatgatgttctgaaagccttctgcaatatcgcccgaaaatgcatgcggtccaccgacctccttggccgctggggtggtgaggagttcgtgatccttatgcccaacagcggggtgatgatcgccagccttctcgccgaacgaattcgtaaggctacgatggctttcgaattcccaattgttgggcgtgtcaccaccagcctgggtatcgcggaatgcagagaggatgaaacctgggattcctggctcgcccggtctgatgcggccctgtatgccgcaaaggcaggtggtcggaaccaagttattaaggatgcagcccatgcgggtgaagccggagaggcagaacttcttgatctggcgtacatgcgtctgggatggcgaaaggcttatgagtccggccattctctaatcgatagccagcaccgtgatctgttcgatctcgccaacaatcttctgacatcggtaatcggagatcgcccggatgatgaagttgttccccaggtcgaatcacttgtggccgacctcaccaagcactttcatgatgaagaggtgatttttaggtcagtgggctattcatccgctgatgatcacgctgaaatccacagatcactgattattagagcaaataatctggtggaaaatttcaagcagggagaattgtcggtcggagaactttttaactacattgcttatgacttcattgccaagcacatgttgtccgaagatcgaaagttctttggactaattcaggcagattcaatgcggcaggctgaatcctaattgattcttcgatttgcgacgacttgtaacaatagttgatatacaggattccgctgattgacctaatggcgacaattccgccacacttttaatggaatttccataggtggggtgccatgcgtcttcggtggcaagattcgatgattttgggtgttcctgagatggatgcatctcatcggcacctgtttcatctgcttgatgccgttgccttggcggttgaagctcggatgttggaagcctcccagatttcggttggagaattcctcgaagcagcatttgagcaccttgccagtgaagaagccctatttgagcggatcgcaggtcaacataaccgggctcgacatatggctacccataatgaagcccggagaactttcaaacggcttcagtctgcaatctgcgacaattccgacctggacgaagcccgcaccattctggacgttttgatccctgaaatgatcatccgactgcaccaggaggacacggccttggcatccgcgttgctaaattgagccaagctcggacgtttcaatgataaatgatccgacgaccgcaccgggcgatggagatggcattggcggcttgctgatgctcgccagttctccagaatgccgccacatcatccagtcgatcatcgatcaccttccgtgcggcgtaacgctgttcgatcagaatctggaaatgattgcctgcaacggcctgttcagacggctgctggatttccctgaccaattgtttgaaggcagcctgccctccatgaaatcccttgccatgttcaacgcacgacgcggtgaatacggtccaggtgacccagaggaactcgctgggcaggttgtccagagagccatggcgatgaagccacaccagttcgagcgtgttcggcctgatggaaccattctggagatttcaggccagccactgccgagcggcggattcatcacgctgtacacggacatcactgaacgacgtgaagccgaggaaacccttcgtgacaaggaggggctgctgcggctgattttcgacaattccagtgtggccattttcaccatcgattccagtggccggattggtgcggccaaccaacggatggcggaaatgttcatgatgccattggaattgctggttggcatggaatacgtcgatctggtcgatcccgtagagcaggaaacagcccgaaagaacatggcggatcatctggtccaggatcgggccaacgtcaacctggaacgccattattggcggtcaaatggcactgcgttctgggggcaactgaccgcccgtcacatgcccgcttacaaagatgggcgtgcgggtctggtctgcgtcgtttctgacatcacagaacgcaaaatcgcggaacagcatctggccgaacgcagccacgaactcgaaattttgaacctggaactgaccaaagctgttgaggcactcgccgcatcgaatgccgaacttgttgccgcccgagaagaactggagcaattggctcagcatgacaatctgacgggcacatggagccgtcgtaggattgaggaatcagcccagcaggaaatgctccgtaagacacgatatggacaccctgtttcgctgattttcatcgatctcgaccacttcaagcgggtcaatgacggccacggccatgccgctggagacgaagttctaaaaacattttgcgacatcgcccaaaagtgtatgcgttccaccgatttactcggtcgttggggcggagaggaattcgtgatagtcaccccgaacagtgggctgatgatcgcaatcctgcttgcagaacgaattcgcaaggcaatcatggcttacgaatttcaaggcatcgggcatgttacagccagttttggcgtcgccgaataccgagaaaatgaatcctgggaatcatggctatgccggtctgatgcagccctttacgcggcaaaggaaggtgggaggaaccgagtcgtaaccgatgcctgcgaggctgatgaagccgatgaagcagagcttctcgatctctcgtttctacgtctggtctggaggagcacctacgagtccggccatgcattgctcgacacgcagcaccgaaatctattcgaacacgcaaataatttgctgacagcggtcatcggagagcgaccaaccgatgaggtggcgcctcagatcgaagcacttgttgcggaccttctggatcatttccgggatgaagaagcagttttccgctcgataggatattccggtgctgatgaacatgcccaaacccacaaggggctgatcgaccgtgccggggaattggtggcaaatttcacatccggcgaacttgccttgggtgacctgttcaatttcctggcctatgacgtggtggcaaagcacatgctatctgaggatcgaaagttctttggacaaatccaagtgatccgcgatacagcaggctgaacgcaggtaggctgatcagacgacaatggcgatattcgggcgaaaaactccccccatccaagtcggggatcgattcatgaaggccaacgaccagacccggaaagtctgggaggtatcccgactttggacggcggtcgatggtgtgccccatgcccggttggtgaaccagcatgagacgctgatggtgtccgttggaactttgaatgatcaggagttcttcgtggccattcctgtgatgcggaacgaaccataaagcagatcggcggtggcgcactggcgagaactccaccgccggatcgtgctggatggatttgggttacgggggatggtccatccagatgtggccgcattgggggaatgccaccatgaaacgctatcgcattcgccctgtgccatcaagacgtacaggatgaacttctcgcccatatggtgaaaatcttgaacgcaaatccgaccacggacaccgcatcagtcacggttacgacaatcagcatcatccatgtgatgaatgctggaaagctgcgtgccttggctgatgttgaagtcgtctttgatggtgtggagatgatcatccaaggtgtccaggtggggacggtcaccagttagatcggcttttccaaaatctaattgggaatgccatcaaatatcgaacagaggggataaggccccacatcgccgtagctgttcgcctcaatgatgggaaggcggtcttctctgttcaagataatggtatcgggatcgcaccagaatacttcgaccgaatttttctgcttttcaagcgacttcatacccgagaggtatacgagggaacaggaataggtctttctgtctgcaagaagattgtcgagcggcacgggggcgagatttgggtcgagcaatcactttctggcggctcgaatttcctgtttaccttgccgacgcatgagtaaacccgtttggttgacgatacctattcgtcgtgccattcgttatagccatacttttcgtagggaggggcaaatgaacaagtccgaattgatcgccgccgttgccgatggtgccaacatgaccaaggccgacgcggcaagtgccatcgacgctgtattcgaagccatcaccgccgccatgaaatcgggcgatgacgtgcgtcttgttggcttcgggtctttctcggtttctgcccgtcctgcacgtgaaggcaggaatccgcagactggcaagaccctcaccatcgcggccagcaagtctgccaaattcaccgccggaaagagcctcaaggacaccatcaatggccgatgacatcaaggctctgaccgctaagattgtggccgcctacctgagcagcagcaccttggcggccactgaaatcccaaccctgatcaagtccgtttattcgactttagccgctacggacaaccctgcttcagcaccggctgaacggcagcaacctgccgtttcagtgaagcggtcggtgacccccgattacattgtctgtttggaatgtggtgatcggcaaaaggtgcttaagcgacacctcacgactgggcatgggctgactgccgacgagtaccgggccaagtgggctttgcccagggattaccctctcgtcgccccggaatacgccgcacgtgacctgccttggaactttcatccggctgaaagtagagtctcggccaaaattacgccgtctggcgcggggtgagcaatggggtcgggcttggagccccggaggggcggagaggccgaccccattgccttgagtttggcggcgtgagccgccggggtttggtatcccagggctgaatgcggcctggcggtgttgtagtcggccacccaggcgacaatgacggcgcgagcctgtgccatgctggtgaagaccgtctcgttgagcagttcatcgcgcatccggccattgaagctctcgctgtagccgttttgcatgggcttgccgggagcgatgtggtgccattgtatgcaatggtcctgcgtccatttcagcacggcattggaggtcagttcggtgccgttgtcggagacgatcatccccggcgttccccgtctggcgatcagcgccgccagttcgcgggctacccgcacgccggagatcgatgtgtcgggaaccgatgccaaacattcccgcgtcacgtcatcgacgatattgagcacgcggaaacgccgtccattctccaactgatcatggataaaatccagcgaccagcgaccagcgaccagcgggcattgggcttggcctcaaccaagatcggcgcccgggtgccgatggccttgcgccgggtgcggcgcttgcgcactgctagagggcgttgacattcaggattgaacgaaatcgctacggcgatattggagcctgatgtgacggcaaaggcccccgtctgacagggttggtttcccgaccaccctacagacaggaggcccccgatggccgagatgagccctctgcgtcgccgtatgatcgaggacatgaccgtccgcaatctgtcaccggcgacacaacgatcctaccttcatgcggtttcgaagttcagccgattcttcaatcggtcgcccgatcggctcgaccatgatgatgtgcgcacttggcaggtccacctggtgtcgcagggtatctcgtgggccagcctcaatcagttcgtggcggcgttgcggttcttctatggggtgacgttgcggtgcccggagattccggagcggattgtctatgcccgccagccgcggcggttgccgatagtgctgagcgccgacgaggtggtgcggttcctggaggcggtccccagcctgaagaatcgcacggcgctgaccacggcttatgccactgggctgcgggtgtcggaggtggtggcgctcaaactcgccgacatcgacagcggccggatggtgatccgggtagagcagggcaaggggcgcaaggaccgctacgtcatgttgtcggcgcagttgcttggtattctgcgcacctattggccgctggcgaggccggagcattggctgtttcccggccgcgaggacaagccgatcgagccgaccgtgcttaattcggcctgccgttcggcctgcgttgcggccggcatcgacaagcgcgtcactgtccataccctgcgccatagctttgccacccatctgctggaggcgggcactgacatccgcatcatccaggtgctgctcggccacaacaacctatcgacgacggcgcgctacacccaggtatccaacgcgatgatcgccaagacaacaagtccgcttgacggtctcgacctgatggtggtgccgccgtcctgagatgccagccatggccgggggattggaggtggcggacggtgttccgccgcttcggtagtgcatggcgggcggcccaggacgggcatcttgatcgcggccgacgccgggtgatggcggcgatcgaggcatgccggacggcgcggttgggcggtcatagcgagtcctgcggcgcgtgcgggctggtgcgcatcgcctacaattcctgtcgcaaccggcactgccccaagtgtcagggcttggcgcgcgcccagtggctggccgaccgtcaggccgagttgctgccggtgccctacttccatgtcgtcttcaccgttccagccgagatcgccgtcgtcgcattccacaacaaggcggtggtctacgacatcctgttcaaggccaccaacgagacgctgcgcaccattgccgccgatcccaagcatcttggcgccgagctcggtttcatcaccgtgctgcatacctggggacaggcgttgcagcaccatccccatctccactgcgtggtgccggccggcggcctatccccggatggtcaacgctgggtcgcctgccgccccggcttcttcctgccggtcaaggtgctgtcccggctgttccgtcgcttatttctggaacagctgacggcggcattccaggccggcgcgctcgccttcttctccgacctcgctgccctcgccgaacccgccggtttcacccgctaccttgcgccgctgcgcaaggcgaactgggtagtttacgccaagcgcccgttcggcggacccgagcaagtgctggcctatctcggtcgctatacccaccgggttgccatcgccaacagccgattgagcggaatcgaggatgggggtgtcagcttccgctggaaggactatcgccatcacgacaagcagaaggtgatgacgctgaagcccggagaattcatccgccgcttcttgctccacgtcctccccgacggcttccaccgcatccgccattacggctttctcgccaatgggcgccgcgccgccaagctggaaacctgccgccgcctgctggccgtgccgacgccgccgatcgcggtggccggcaccccggatgactaccgtgatcgccatcaccgtctcactggccacgacctccgccgctgcccatgctgcggcggcaccatggcgccgctcgcacccatcccccgatcgccggccggccatgccaaccaccggatcgacacgtcatgaccgtcgctctgcttccgtccctcgtgaccgcgattacaccgacggtggccgtcggcgtcgccgctgctcgcccaattcacgtccgttcggccatcacggcgaccacgactgccgctgatcgccacctccgggccaccgccgtcgccattgcagcacccatcaccacgcccgtgtgcgttccgtcggccggcttctccgcgcggatggcgccagccatgcccaccgccatggtcaaatccccatagacctcgtccgcgtcccgcggtttcgttcaatccggcttctcagaggtccggctcctttggggctggcgcctccttggccggacctcagagaaccctccagattcccacggcccccaaaatctgattcaaactccttttcgagaaggaggcttgaatgagcggggtccgtttgatcttaaaggatcatcagtgggatcggatggcgccgcatttgccgggcaagcgcagcgatcccggcaggactggtgcggataaccgccttttcctggaagctgtgctatggctggcccgaacgggttcgccttggcgtgatctgccgaattttttcggcaattggaacagcgcgttcatccgtttttcccgctggtccaaggacggtgtatgggatcggcttttcgccatgatggctgacgaccccgacttcgaatacgtcatgatcgactcgaccatcgtccgggcgcaccaacatgcggcgggcaaaaaagggggcctgaagctcgtgcgatcgggcgttcgcgcggcgggctgaccaccaagatccacgccatcgtcgatgccttgggcaatccgctgcgctttgtcgtcgggccaaaccgaacggtagcggatcatggtgcgatccgccgcgatcaccgcacaggcccgacgctcgctcatctcgaattggcttcgcagatgggcgacagcttctcgcttggcggcgggcctcaccatttttttcccagcagatcgcggagcgcggcctcgttcagcatggattccgccagcagcttcttcagctgggcgttctcgtcctcaagcgctttcagccgccgggcttccgacacgtcgagcccgccatacttggccttccacttaatgggatggacgtctctccccccaagcggcaacgcttgcaaaggggcgcatcagatgttggaggagatcatgacgatcacatacatgggtatcgatctggagaagagcgtgttccaactgcacggggcggatgccgatgcgcggcctcctgctggaccgtggcttcgcgatcggtgcttcgatcactcgagcccggcgcgccatccccgagatcatctccgatccgaacaacggtttgaccaccatggctcgggaaaccatcacggaactccacgagtttcttggtcagatcgaccagcggatcaaagcgttcgaccgtcgcatcggggagatcttccgcgcgaatgcggcttgtcaacggatcgcccgcatctttggcgtcggccccaaaacggccaccgccgtgatcgcggcggtcggagatggcaaggagtttaagaatggccgacacctttccgcttggatggggcttgtcccacgacagcattccagtggcagtcgatagattctgatggggatcagcaagcgcggcgatcagcacctgcgaaccttgctcgttcatggcgcgagagccgtggtgcgggtggccgcgagacggagtgacccgttcagccaatggatcaatgcgctgcgagagcgtcgcggggcgaaccgggcaattgtcgccgtcgccaacaagaacgcccggatcatatgggcgatgcttcggcgccatgaggaattccagcccgcgacctgaggctgggataagggttgcatggagatccaagaaatgtgaccgaccggcaaatccggtgtgtgaggaacctggcttttataacggccccatgaggccgaccacttgttgaggctcaccacgcggaattcccatttgggcgcaccgacatccggtgacgccggatatgccagcatgctggccagtaagaaggcttccctgcaggtggtcggggccttgggctggcggctgagagcaacctggatggccaaattggccatcaattccgcccgttcgttggcggtaacaatttcgtccacgcttagcaccttgtcagttgatggccggcccagtagataatgcgaaagtctggacgaacaagggttttgagacgcgcttggagcctattggacgatgatgatcacggtggatagcgaacctgatcgagaggcgaaactggcggagatcgtcgccaagatccgccagattctcgtcggagatgacccacagggcatcgttgagacagtcacgcccgaaccgccgcaacctgtgctgaccgggatcagtgtcggccgagcccaccgtttaacccttttggcgaaccatgtgttcggcgatgaggataatgcctgcatctggttgacggagccgcaggagaggtttgggggcaaatctctgatgcaattggccgagaatcccgccgttgccgatcatattgaggaggcattgcggcggatccatgaggaacagattttcaaggattaaccaaaaattcgcgccaaacgcggcctcatcaaataaacaatgcgaacaaatggaccatgaattcgaactcagaacagaccaaaagcgcacttgatcaatgctttgtagatacagttaggcatttgtcacatatagaggcgccagacaagcttgaaaaattgacggaattgcttttgatggcggttctctcgagagaaccattgaagccattgcgggatgcattgattgcgtccatccgctacacaataaatgaagtgcgcaatcgaccatcaggccatggaagacggaacgccatgaggctgtctgtggtgatgtgccgaaaaactctgcacgtggccaggatcgcgtcaaaagtgagctgaccatacgaggcatgatctggctgaaatctcgagcgtcgtgccttgtatgtgaggcgcgacgctcaggcagagggcgcaccacttcggtggtgccgaggaacggggggctgtgtagcgccatggccaagaatgcccccagggcttcccgcaaatggcaacgacgttacttgcatctgcagccgccggcaacgcgttactattcggccggggtggccatgaaggccaaggcgttgatgtgtgtgtggcgggctcgcgtcataatgcccaagacctcgttcggcgggaatgtctcggtgctcatggaatggacgttctggacacgcctcgttcgcaatgcccgattttatcaagtgccgctattcagcggatttccgcccatcggccagagtcttacgatttgtcgcggctgataggctgagtgtttggtgagcactatcctgcggcttccgcggccaggagggcgagaggacgaggatccacggcggaatctcttatccaccgcttatactgcatgtcctcattgaggatgtggtgagtgagccatttgacaacgaggtcgggaaggtcgtccgccgctgacttggtcccactttgataggtttcggaaatcgccctcaccctggcttgaaacttacggtgtttatggtgatgttccgagagttgcgtatagccgaccgctttcagcgccttttcctcgcgaaggaaatgcccatccacatactcttccaggatcaagagagtgctggcgatgatcaagccctgatcccgcttatcggcgagcgaatcgtaaagcagccgagcaatgtcaaaaaatgccttatggtcggagtccagcgtgtcattacccacggacatctcgggggtccactcagggattgcgcctcgagcggcaccactggcttccattttcccctccctacagtggcttttggccccaggtagttctggtgccgctcagcgagcagattgtgccaagccatccgcaggtgatatgactaacgtaacaaaggctcatagccgagggcctgtcaagggaggctatcagcatggccatctgcattagcggcaatggacacagcttccgtgacaatgagatcatcgtcagcaagacggaccttcaggggcgaatgacctattgtaatggcgtttttattcgcatctcaggatacgcggaagccgagttgatctgaaaaacacataacatgatgcggattgacataaatcaatctgacgagatgttgtttttagcgcatttttatcttggcggtgcatatcgcaagaattatcacgttgatcttgcagcctccggtacatcgcaggtcctgttaagggcttgcagactgaccgcccccccccccagccgcgataaaacgaagccgtttcctcccttcccgatgacgtcgaatccctgcgccatatcatcgccgggctgaccggagagttggcggcggcggtcagcgcctcttcatcatcccgcccctgtggctcacgtcgctgtatccagcgtggctgcccctgcaccaggcaagtccggcgctccggcacagccaaccgctcgcacaccgccatgatgcagcaccggcgacgggcggggctcacttgaccggccccggcacctcgatgcgctcgaaagcggccatacgctgacatgtgaggagagtggcgtttgcccatcttcgcctgctcctaggctcgtcattttgccggaaatgcgagagagaatcacttgcactatcagccttcattcgactatacccacatctaattcgagtcattagcaaactcattaagggagggttccagatgaagtggacctggtcgagtggaatgtgcactgccctgctcctcgtatcagcctcggcatgggcagccgggggctattgggctggaatcgccgaggaagtttgcacagaggttaccaaggtcgaaacctttgccaaggcaggcaagatcgaggacgccaaggcggcgttccacaccgcctatttcggcaccttcgaagaaaagaagatggagatcgccgagcgctccaacttcggcatctcccatactgccgatgtggaagagatgttcaacaatctccgcaaggcagcaagcaagcccggaaccggcgacgtgtccgccctggccgagacgctgcgcagggagttgcgcaaagacggcaaggcactcgatgccgccaaagtgaatcccgatggaaatgagggaaaaaaatgattcgccacataattctggccatcaccatggtggtcctcgccgcgttgcccgcctcggcgaagacggtggacgtccccgccaccatctccttgatccttgagggcggcgatgccgccatcgccgcctatgcccccgagcgcaaggccgccactgccgatgccatgtctgatctttacttcgattccttcgaggccagtggcctggaaggtgcgatcggcatggtcgatgcctcgtggaaaatcggtctggaggggcagttcggccaactcatcggaaagatccgccagggcgactctccggaggtggtgaaggcgggctgggcctcgctgcgcgccaatctggccgtcgttccgtcgcggatggcccccaaggggggagggttctggagcatgttccttcagtctttcctgatcctggtgcgcgagggcttcgaggccatgctggtgatcacctccctggccgcctatctcaagcgttccgctccggagaaggtcaaggtggtctatcacggggttggctgggcggtgatcgccagtttggtgaccgcatgggtggtgtcggccctgatcaatgtcagcggccagggcaaggaattgtttgaaggctgcaccatgctgctggcctcggtggtgctgttctattgctcgtactggctgttcgccaagcgcgaggccgcccgctggcagagctacgtcaaggagcaaatcagttcggccctgtcgggcggccgcctgttcgccctgggcttcgccgccttcctggcggtttatcgggaaggggccgagacggtgctgttctatatcgccctggcttccggcgagccgggccagatgacggcgctgttggcgggactcggcgctgcctgcgtggctctgggagccctctacgtgaccatgaacgtgatgtccatccgtctgcccctgggtgtgttcttcggggtgaccgccggactgctctactacttggcggtggcgttcgccggcaagggcgtggtcgagttgcagaacgctaaggtgcttcccatcactccgctggaggggtggccgagcgtcgattggcttggcctgttccccaccctcgagggtgccacggcccaggccatcctggtcgtgcccctgctggtcggcatccttgttctgcaattcaagaaacgagccgcgagggcagcgtgaacaataaatctttcgacgaggttcggaccaaggcgtcggtgcgcccagtttcggcacggaaggtcgcggcggctgtcgaagagttcttcgtccgcaatcgcacatggctgtcatgggtccatgcggccatgttcctggtctttctcggcatcatcctcgtgccggtttttctacccgatcctccgggcaacgccacgccgttgacccattacaccacctttaccaattacctattgtggggattgtggtttccgctggtgttcatgtcggtgatcgtcaccggacggtcatggtgcggtttgctttgccccatgggggcggcggccgagaaggccaacgcctatggaccgaagtttaagattccccgctggctgagctgggaaggaacgccggtggtaagcttcctcatcgtcaccattatcggtcagacggtgggggtgcgcgaccatcccgaggccgcggccgaggtcttcggcggcaccatgctggccgcgatcatcatcggctggctgttcggttccaagaaacgcgcttggtgcaggcacgcctgcccaatcggcctgctgctgggcgtgttctcgcgtctgggagcggtggagttcgcaccctggacccgaaagtcaaccacagagggatacaccgaccgaggtgtatgccccaccctgattgatatctctcgcaagacggaatcgcggcactgcatcgaatgcttccgctgcgtcaatccatcggccaagggtggggtccacctggaattccgcaagcccgggaaagagatcgagcgaattcgcgatcatcacgccaatccggtggaggtgtggttcttgttcctcgggaccggcatcgccctgggtggctttctgtggctggttctgccgatcttccagaagatgcggcaaagtctaggggtgtggagcattcacaacggcctgacctggatggggcagcccggaccggcttggctgatgagcgttcatcccgaacggaacgaaattttcctttggctcgatttcgtgatgatcaccggcttcatgacgggctgcatggtgctgctggccgtcgttctggcggcgttcacatcctgctcgtccgctttggcgggacgggcgggaggcgatggcacctttggcagccgtttcaccgaattgggctaccaatacactccggtggccatggtctcactgatcatcggtcttggcggcaagttgttcgaacccatcgcctataccccgctggggatcgatggtgtccatggggcgaagggcttgctcttcgtgatcggactgctgtggagcatccgcctgggcgaacgcatcctcgcccgccagggggtcgcggcctcgcgccgctggctgccgctgttgcctggccttatcggcacgctggcggtcggcctcggctggtggccggcaatcttcggtctcatgaagtaaaacgccttgtggcgactttccaaactcacatttccaacggaggtaagcatggttttttccaagtattccagcgtggctacggcggccatggccgtggtcctgctgtctggtgccgcgaccgccggagagatccgcattggcgatccggtcgagaaggccgggatgaagattgccggcgtctatctccaggcggtcctgatggatccggagaatgatatctgcggcccccacaccgccgatatccacctggaagcggacgtgcacgccctcaagggcaatcccaacggcctgggcaagggcgaatgggttccctacatgaatgcatcctatgtcctgaccaagaagggcagcgacttcaaggatgccggcccgctggtcgccatggtcgccaatgacggcccccattacggccgtaacgtcaagatggccgggccgggcacctatcatgtggtgttcactcttcagccgccctcggccaatggcatgggccaccatgtcagcaaggagacgggtgtcgctgaatggtgggcgcccatcacccaggaatgggacttcgattatgtgggcagcaccggcaagaagggcggttactgatcgcttcttcgggtctggccggcatggcgatgcctgccgcgtcttgatttcgtgaacacatcacacccagaggtaataatgcgtctcactctcgtgaaaacggcctacgtcgctgccgcggcccttatgctttccggcgcagccggtgccgccgagcgccccatcggcgaagtcgaaaagggcggcatgaaaatctcagccgtctatcatcagggtatcgttgtggagccgaagaatgagctctacggcccggacaacgccgatatctatctgcaggccgatgttcatgccctgaagaacaaccccaacggctttggcaagggcgagtggctgccctatgtgacggcgtcctatgtggtgaccaagccgggcagcgacttcaaggccgccggcccgctgccgcccatgacctcggtcaccggcccccattacggccgcaatatcaatctggcgggaccgggcacctatcatgtgactatcaccctcaaggcgccggtccacaataacttctaccgccacaccgacaaggagacgggcgtctctcagtggtgggatcccatcacccaggaatgggacttcaagtttgagggtgccggaaagtaatgccggcaccgtttatgaaatataggtcggcatgggcgcggggagcagcacctgccgatgaatgccaaggggatatcatgaataagcgtaaatataacggcgacgctaaatcgcgcacttcttttggattggttgtggtctcgctactgtccttgacggccttggctcatcccgccctggccgacggggattgtgaggtaactcctccggggttctgggaacgcgacaccgcgctgggcagcttcggcggtgcccgcaccgagctgtgcaagaagggcgttcaactgggcgtcacctcggtcaacgaaatgctggccaatccgtacggcggcgtcagccacggcggcaagggccaggggcggatgcagttcgatctcgatatcgatctcgagaagatggccgagctcaagggaaccaccctgcatgcgggcgccatgtggatttatggtggccggatcagcggcaagaatctcggcaacctgatgccggtcagcaatatcgaggccattccgtcccgtcgcctcttcaccctttggggacagcaggtcctgttcgatgacatgctcagcgtgcggctcggtcagcttgcggtcgatgatgaattcgtggtcagcaagctgtcctcggtcttcgtcaacagcaccttcggcttcccgttcggaatttccggcaatcttcccagtggtggcgccgctttccccatgccgacgccgggcgctcgggtcaagctgaacctgacggacgaagtctcctggatgacggcggccttcgctggcgaccctgcgggcaagttcgacgtccgcgacccccagtggcgcaatcatgacggcaccaccttcagcttctcacgcggcacattctacattaccgagggtgcctatgcggtgaaccaggagaagaattcaaaaggtcttcccggaacctacaaactgggcgcttggtatcacagcgcccgtttcaacgaccagcatttcgacaatcttggtcaatctctggctagcggaaacaccaccggaatcgggaatccggtccgggggaatggtggcgtctatttcgtcatcgaccagatgctgatcaaggggcagcgctggtccgaagaagggctgggcgtgttcctgcgtggcggcgtctcgccttcggaccgcaaccaggtgcccttctatctggatggcggcattagctacaagggcctgttcgctggccgtgaggaggacaccttggcgctaggtgtcggctacgggcaactcagcgggagtctgcaggggctggatagggatacccggcagatcaacggccagccaacccgaccggtccgggactacgagactgtcatcgaggtaacctatcaggcgcagatcaccccctggtggacgatccagccggacgtgcaatacgtcattcatcccggcggcaatatccccaacccaggggcggggagccagttcaccccgatcggtgacacctttatcttcggagcgcggaccgcgataaagttctaacagcttaaaggcgaccattccgatcctggcgtgggatcgggttggtcgccccgtcgctaaaatggcgtctgagaaaattttccactcgatgaccccattgggtcataagcggcagaattaccaatcgctgcgggaccgttccgccaaagaggcacggctgaaagcctccgttgcctcccgtaccgttacggcgaccgcgtatttccatcacattccgctttcccgcagcagagccgcggctgccgatcgcaggatgaaacccgctatactttccggctcggccttcaggacagccattcctcgcaactgggtggcctgtgcagggatggtgccgacacagcgaatccggtacagggcctgatcgggaaccaatgacttgtccttggcgcgaacttgaatcgggccgccagccaccgaggcaagcaccggttccgtcaggctgcggatggccccgctgtcgatggtagcaatcctgcacggcaggtcggggcggcccgggtcatcggcaacaaaccgcccctcgttcccaatgcgaagtcttcccacatcgctttcggccacgaaggcttcgaccgccaaggctccggtccctgccagttgggcaaggcgctccctgggagaaatccactgcccgatctgaagatcgggaatcatatccacgaccctgcccgccatgggggctgtgacggaaagccgggccaactcccgctgcaatgagacccgctcggcgatggcggtttccaattcctcgcgcagggcctgggaccgctcgcggaaagatgcatcgaatgagaacgacgccagttcgtattccaggaccaggattcgccgctccacctgggccaggcgatactcaagatcgggggaggatagcagcgccaaggactcaccctcggcgacctgccttccctccaccatcaagatgcgttcaatccgggccgggctggcggcataaagctccagatggcgttccgctttcatgacggcaggcgcgctgacatgggcgcgccacgggaccagggccaggacaagcgtggcaacaaagaaccccaccggcagcaaggaccgccgtgaccgtccgatggtttcgcgacgtttccaccactccttggcctcgttccagaacggcagaaacacgaaccatcctatttccaccgcaaacaacaagatccccaccgccttgatgaagaagtgataaaccaggacagccatgaccgccaatgcctcgaatgcacagaaagaggagcgccggacttgcctggtgctgggacagccacgctcgacacagcgacgtgagccacaggggcgggatgatgaagaggtgctgaccgccgccgccgccaactttccggtcagcccggcgatgatatggcgcagggattcgacgtcatcgggaagggaggaaacggcttcgtcttatcgcggctgggggggggggggctgcaagcccttaacaggacttgcgatgtgccgggggctgccagagctttatcgcttctgattttatttgcgccgtaacttagcaatatctttaaacaatttatcttgagagcatgcgggaacttggctcgccccgccagtgggtgtgtcgttggtggttgccattatttgacagtattgcatcagaatgtaagaattcataaattctttgtttaagtccaaagagtttttgaacgaactggcggcaagttcaaattgataattcttgcgatatgcaacgccaagataaaaatgcgccagaaacaacatatcatcagattgattcatgtcgatccacgcgctgtacagtctaattgcacgcacgaaatcacccgcactaactgctttttcggaaatttctatgatttcggagatcgaaaatccgtcattcgacacgccaaatgacctccagggttgtttggtgctgattagatcgcctcgcgtgccaggatgtgatcaagactgagagagactttgaaggagtttgcgccactttggagatatcgttgttgagtgtgatgtcgaggacgaagctgtgggagcgggtcatgtcgcggttgttgtcgatgctgtttttgccggtatcaagagatgtgtcttggacatggcggtttcggtgtagagcaaggtgcggcgggtgacgcgaatgattgccccctgccggccccagacgattatggcaccggcgaaagcggcagtcaaacccagccatgtaaaccggagcctggagcggtgacgaactggcggcggcagataggccaaagtgacgcataccgttctcccaaaatgcagatggccgaccgggtggttgtcgaaggcggtccggccggcctcgcggggggagggcgaattggcgaaaccgctctcctgtcggaattgtgcgcgatctccaagagcagtcaagcaattgataccggcggacgaggcgcgtgttgagcccgttggctaccgcatagaggggggccgcggtcgcccccaggttcggctgatcccataatcctggtttcaatcggtcacgtgatcactccgccatcagtgttcaatgacacgctctcaaggggagtgaatcatgaaagctgtcgccctcggcgatctccatcagagtgacggccggagccggatggttcagatcgagtgggcaacctcctgagacttcacatctagccgaataaatcggcataagggtcaagttccgcttcgggccgtttcttcggcgtcttcggacggaccggcgccttgggcgtccggaacgaggaaatagcgtcccagatcttgatgaacaggctttcgcggccatccaagatgcccgcttcctcccgcttttgccaatggacctcgcccagcccggttttgacggacggacccgtcgccacggccggcgcggcttcgacggccggagcggggggcggtggggcgggtacggcgtccgtcggaccggcgtcctgaagatcgcttcgccggggcttcggcgtcctggccttggcgcgcctggtggcggaaggggggggcgtccgctccgtgtccgcggcacaggaggccgcattgtcgcaaaccggctttccgcatttcctggtcacttgccgcgtccatcccatcacatgaggtcttgaattacgtcttatcagattcgcggagagttttcgccatttcatggttgcctgggggaaggtgatctccatgggcggtgacagaagggcgccgcgcagggtaaatagatggttcggtcgggtgcgggcttcctgcggcaaggcgtgatcaaatgacaaccacggaccgtgatgccgattgggtgggatggtgccgcgatcaggcggcgctgctgcggcgcctgcccgtcgccacctgtccggcggggctcgatccccaggcgctggctcaagagatcgaagacggggcgactttgaaggtggatcaggcggccgggtggatctttcgcgccttgctggccctggtgaagcttgcggcctacgatgatcgcggccaattgcagcgcctggatttcacccaatcccaactggccctcgtctggcggccgggctttcggcgtcatctggatatggaagatatctggctgcaggtccgcgaggcggccgggcagattcggccgaccgccattgaactgccccgatcctgcccgattctgctggaggacatggtgcctcgggatgggggggctttcgatgtcgggaccatggaggcgaagctgctgcgggcggggctgagccgccggagcggctaatgggcggggcgtacgatttcggttaattcagcccaggctggtgttgctgcagatgccgtgaagatcggcgctcaccttccgcttggtattgccagatatatatatgccatttgccgttcttgttataattgttgcgtgacgccacgcagcaatcacagtctggaatttgaccatgcatcacagttgcaagcgagcagtcatcgtcgaggattcgccgcaaatgcggacgctgatcaaggtcgtcttgcatcagttcggcgtgacggaggtcgttgaggcggaggacggtaacgaggctatgcaggtcctgcgtgaaggcggtgctgacattatcgtcatggattggatgatgccgggcatggatggcattgaatgtatccggcgcatccgagccgggcaggacgggattgtcccgagcattcccataatcgtggccaccggggtgcaaggcgacagcgccgaggtaatggccttggcggccggagccaattgcttcctgaaaaagccattctccatcaagaggctgcatgcggccttcgtcatggctctgggcgagagtgccgccccgatgaactgatgtgatcgtcgattctgcacagggtcggacggatggcttgctgtgccccgattcccgccgtcggcatcccatcgggcttgtttcagggacgcaataagcccgggacagggggggctgatctggaaaagcagccatggggaccggtctgaattaagccgtgagggccatttcttccccgtgacttgcgcggcacactccaatactcacgtcgctaccgcaactgattcgcaatattgcaacttgggcgcaagccatgcggggatttgcgttcagatcatcgtgcgtcaaatctaatggggtggacggcccctgctcaccggcgtcgcaatgcgccaagatggtggttgtcgagacacaccatttgaagggggccgtccatgaccgaggttagcacgattggttttgatctggcgaagcgggttttccaggtccacggggtcgatggcgacggtgccgtgacgatccggcggcagttgcgccgctccgaggtcgtgacgttcttcgccaagctgtcgccctgcgtggtggggatggaggcgtgcgcctcagcccattattgggcgcggacgctggccaaactggggcatgaggtgcgcctgatcccgccctcgcgggtcaagccctatgtcaagcgaggacggaagaacgacgcagccgacgctgcggcgatcgccgaggcggtgacacggccgcacatggagttcgtgccggtcaagagcgaggaggcgcaagcggtgctgatgctccatcgcacccgccgcctgttggtgacccagcgcaccatgctcggcaatgcgctgcggtcgcattttgccgaatacggcatcatcgaaccggaggggcaaggtgggctggcaaggctggtcgtctgtgcgctggacgcaccggatgcggcattgcctcaggcggctcgtgaagccatggcgatgctggccgcgcatgtgcgcgagatcgactccaagatcgatgcgctggatcacgaaatcctgagatggcaccgtaacgacgccgacagccagagggtcgcctccattcccggcatcggcccgctgatcgccagcgccatcgttgccgccatgggcgatcccaagcgcttcaagacggggcgagacttcgccgcctggctggggctggtgccatcgcagaattccaccggtggcaaaaccgtgctggggccgatcaccaaggctggggaccgctatctgcggtcgctcctggtggtcggcgccaccggcactttatggcggcggcgcaaagagcaaggcacatggctggcgggcatgatggcgcggggtaagacggcacggcagatctccgtcgccctggccaacaagatggcgcgcaccgcctgggccatcctcgccaagggtggcctctatcacgaaccggcagcacaggccgcctgagaaagagcgcgaggaacaaccagttgcgagggcgatgaaagcgtgatggcgaccggtcaatccaaggaacggcaaaacccagcgtacgtcatggccgccaaggtcgtaaatctgatcgggagccgtttcacggatcacatcatggccagcggtcagagtgccgcgcaaacaggccggacacatgactgcacccgaccggagcgtcagcgcgaaaaaatctccttgcaacgcaggggctgtccacacatgacgcacgatgatctcgctttatgttggtccctctgcccgagcgcggttctccggccgtttggccgctcgcccaatgctcgcctgagcgtcgcgcctcatatttgaaggcgcgccgctcattccaaaatcttggatcggctggagccaaatcggcgccaatcttgtcgcggtgcaggttggacggaaggcgtcgcccgcggctgaggacgctgttgatcggttccaaccaatatttcttagtataaatgagatgccaatagataatgcataggatataaatagaataaaatataaaatgcgtctaattatcgacaatttttacttgcgacccccccccccagacatgtaataaaatgtgacgatcgtcaaccggggtggtgggcgtcgtgggagatgataatggtcgctacgaatattggaggggcaaaggcattgacaatgtcgccgatggtcggcaagaccttagcgatctgtgtcagtgccggtattgggtggggcgttctttcggttctcgctgtggcggcattgggtagtgtctatctatgccgcaaattcgcaggggaattgggcgaacccgtcagcgatcttgaggcataggccgcgatcatttcgtttgccacgccatgcgtgacgatgatctgggcagacttgcggaaaaaatcgtgctggcgtgggcgggctgctgcggtcgggcgatcaagccgaaacaggacgtcgtagcgtcggttttcataacactgcgcgaaatctgcgagcacggccatccgcaatcgggcgggcatggaccgtccaaggccgccgaccggcggaccgggcatgacacctcggtcaagctgatcagctgccccgactgcgattccatcatgcgaaaccatgccgccctggctcggcatcggcggttctgcgtcaagggaatgcgcaagatcaacctttcgacagactgacccatccgccgtggggtgttttcggccccgcttggtttctgccatgccgctccgaagggggcggtcggccggaaccggggggcgtcaggccagttcgtcccgcaagatgtcctcgtcggaagcgccgttggcagctttgccgcggttcagttccttctcgaccagatcgacgccgcgatcccaggcatatttggcggcaacgccggccaccaaggcggtgcccagcgatacaaccaggccgccgccgacggcggtcgcggccacggcggaaagcgcggtggccaggccggcgccgacggtttccttgccggtatcgatggccgcttcggtattggtgatgcgcttttccttcaggaggcggacgttcttggccaaggcggcggcgccgccgaccagggcgccgagaacgccgacgccgggaacggatttcgccagatagggggcaaggtgaaagggcattacgatggtccttgtggttcggatgtcggtcttattcttccccggccgcagccaggagcgcatcatcggacaggtcgggggtgccgtggcggcgtcgcgcccagacatagagcgcggcggccccggccagtccggcggcccccagaaggaacggcccccaggcgccgagtcccagaccgaggccgaggccaagccccttggcggacagcatggcgctgccggttccggcggcggtgatgggagtgacggtgccggctccggcggtcagcagcgacgaggctgatccagcgcccacggcggcggctccgccggtgccggtgacggcggccggaatgaatttggcggcgatggcgccgccgccgacggccttgcccgctccggcggtcaggggcttcaggaccaggaatttgccggtggtgccgccgatgacggggctgggggcgaccacgaaggtcttgcccaccaggccgccggtctgggtcgcggcgttctggacgttgatggcgatcagatcgccgccgccgaccgggttcagatacagcatgccggccgccttggttccggcggcgacggggggctgggcgatggtgaagctcttgccggccagggcgggcaggttgacggcggcggcggtgccttccaccttcatcatcaccaattgtcccgcgcccgtggcggcggcggcggccttggcgccggtgaccggggtcaaggcgatccagttgccgataccgccgatggcggcgggggtcttgccgaccatcacggtcttgccgaccagagcctgcagttcaaccacctgccgggtcgcgtccagcttgacgatgattggcgcttgtccggcggcggtgggggtgatggtggcgagattggtggccgccgacaccttggtgaccgtcgcggtctgaccggcgagggcggaaacctgagacgcctgcatggcgctttcgaccttggccaggagaaggtcctgcatcgtgtctgtctttccttacggcggcgagaatgccgctatgcgcctgaaaccggcgcgcttgtcgagcggctttggattagatcaacgcgacgaaatagccgaccagcggcaggcgccaggtgcggcgcagcgccaccgaggccagaccagccaccgacagaaccagcacgcccatggacgagaaaccaaacagccacttgccgatcaggggaagatgcagggcgaacatggccaggacgctccacatccacaagaccaagccctgcttggcgtggaagtacacatattcgtcgtcccggctcatcagcagcgggacgaagcagagaatgcccagatagctcaggcccgccatcagataggagcggcagccgcagggggtattttcggtttcgagcaagattgcctcagccattgtcgtatcctcgcttaagtcgcatcggcggcggcatcaacctccgccttgcagtttttcaatttgccgaccagataggcggcgcccgccagcccggcgatgccgacaagcacgggtccccaggcaccgagtcccagtccgagcccgagacagacacccttgccggtcagcatggcgttgccgatggcggctgtcccgaccggagaggcgatgatgccgctcccgacgccgagggcggctccgccggtcccgacccccgcggcagccgaagcctttgccggggcggcggcgtttgccaaaatctgccctccaacctgagcggccatgactctacactccgaatcctcacgtacagcctggcaagaataattgaaacaagagcccaggcaaacagaaaatgcgttgatagctcctctcaacttatcttcgggtcatgtgatcttcggctggggatgactatgcgcttcatctccagatattttgttgagagtgatttgcatgcgcgccaaaccggatggggttgacgtattcaatcctggtcggcttgggaacaatccctttggatgttgacggtggcttgtttcctgtggcactcgaaagtccccggccatgaggtgctcgtcatgcttgatctttgggatgtgaccgccgcgctcgccgtggtcgttttagtgggggcctgggcggcgcggcgtttctatcggggcaaaggttgcggtctcggctgcggcggctgcaagacgccaaaggcgggaaggtgcgactaattctcttttgctcttctgagagagaaaataatagttggtcgcaacttctccgctgtcgtgacgttgtcctcgtaacgtgttgtcctcagcaatgatctcatgttattgatgccgctagtctgaaggggggctggcgttttcagtcccgcgctacttgattgtgaggagaaccgaggtgccagctcagatcgccaacggagttatttgccccccaggggccccggccggaaccaaggccgccgccgccatgggcgagatggagcgcgagggcgccgccgccaaggccggggctgccaagacgggcgccgccaagaccggaaccgtcgccaagaccggcatcgccgccaagacgggtgttgccaccgccgttgccgctccggcggctcctgccaatgttgccgccgcccagggcgccgggaccaaggtcgcccttggcgcgggcaaggccgccgccggtgccaaggtcgtcggtggaaccatctggaccggtaaggggctgggcctcggtctgggtctcggtctgggcgcgtgggggccgatcattctcggcgttgttggcgccggggcggtttacgcgtatatgaagagccgtgatatcgaatcggcgcagagcgacgaggaagtcgaactgcgcgacgcgctggcctgaacgaggaggaggggggaatgactgaagctatccttcgcagcacgctcggtgcgcgcacgacggtcatggcggcgctgtcctatctcagcgtcttgtgcttcgttccgcttctggtggatcgggacgacgaattcgtctacttccacgccaagcaggggctggtgatctggatgtggggcgttttggcgctgttcgcgctgcatgttcccgttctggggaagtggattttcggtttctcgtccatgggggttctggtgttctccctgctcggcctggtttccgtagtgttccagcgggcgtggaagctgcccctgatcagctgggtcgcccaccggatctgatctgatcttcggacccgatgatgcgcatctcgacgtctcgctttggcgggcgttgggatgtttcgtttctggagccccgcggggccgtgcgcgggccgcgtccgcaggccgctcgcggcacttagttaatggcttgccaaaaaggtcggcgatcatgaagatcgccccggcgggtctgcctgcctgatcggcggcagcgaagccagtgggagcggagcctgatggatagcaacgaaaaagaacaacccctgggcggacgccgccccgcgcgacgccgggacggcggcggccaggtggtggttctgtatctggccgtgatcctggtgggcggcgtgctggcctggcccttgctggcgccgcgtctcggcggccttcccggcccctgggccaaatggctgggggacgagatgggctccacggccgccgcgccccgaccggccggcctggacgaacgggtggagatgctggaagcctccctggggcctttggccatgcggctggcggagaccgaccggcggttgaccgtgattgaagccgtgatccgcaagcaggagcacgaaccgcgcaaggaggcagccgccgccgccgatcaggcgcagatggcgcgtctgtccgccgaggtggccgccatcaagggcgatctggacgtggtccgcaagctggcgaccgacgaagggggcgccgccaagctgtccagcgcggtggaaaaggcggaagcggcttttcgccgcatcgccgaacgccgcgaccgcgcacccttgttcctggcggtgctggggcaactgcgggaagcggtggaccggggcacgccttatcccgcccaattgaaggcggccctggctctggccgagaagggcggcgccgacaagctggcgccattgaccatgggggcggggaccggggtggtctcccgcgtggccctggccgagagcttccgcatgacggcggcggcggcgcgcaagctcgacgacgtcgccgaaagcagctggattcctgccaatatccggcattggctgggatctgcggtggtggtccggcgggcggaaaacagcaatgaaggcatcgacggggccttaaacagcgcctcccggctgctggcgggcggcgatctggccggggcggtcacggtgctgcgccatgccgaaggtcccggcatggctgccatccagccctggctggaagcggcggaattgcgtctgaccgtggacgcggtgttgtctgaactgtcggcgacggttatgaccgtcgccgcgtcccgggacgagtgaccatgctgttgcgccttatcgtccttttgatcttcatgtcgccggtggtgctggccactttgtggttctcggacaatgccgggacggtgcaggtggaatggctggggtggcatgtggacaccaatgtccccgtgcttctcggcattcttctggcggtgttcatgctgttttccggcctgacgcggctgtcggcgctggtggccgatctgcctgccaagctgggcaagtcgcgacaggcccggggacgggaaaagggaatgctcgcccttttggcggcgctggacgcggccgaaagcggcgatgtcggcgacggccgccgcctcggagcagaggcggcccggttgctggacagtcccgagcttgctgcccgcctggaccggctgataccgcgccccgctgcgcctccggcggcgacgctccggcccgagccggccaagggacgtctgttcgcgaagaagccgcccgcaccgccggtggtcgaaagagagccgccgccgccggtcaaggccgcgccgccgcctgctcccgtcgccgtcgtcgagacgcctgccgcccccgccgatcccagcgccgaggatgcggccgcctttgccgccaaactccgggatggcgagtgggcggcggcccaggcatgcatcgacgccactctttccgccgggcggttgtcgccggccttggccgcgcgatggcgggccgtggtgctggaagggcaggcatgcctggactcccaggacgatcccgctcggtccttacggctggcgcgtgaggcattggccgccgatccgggctttctcccggcggctctgcacgtgcttcggcaggaggtgtccgaaggtcgccggtccgaagccgaagcggtcctggccgcggtctggcggagcgctcccgcccggattttgctggaaacctgctcgccgctgtggcgcgaagacgatgccgaaagccgtttgaagcggcttgaggtcctggcggaatgggctccgcatgatcccgaaggccaccttgccgccggggaagcggccgtcgccgccgccaaatggggcgtcgcccgccgtcacctcatggcggcgctgaagatcgcgcccgatgcgttgggatgtcggctgatggccgagatcgaggacaaggagcctggcggagcggagcgggcggaaatctggcgccgccgtgaacgcgaagctccggcagcgcccacctgggtgtgcgaggcttgcggcgctacctcggggtcatgggcgccttattgttcggcctgcgccgccggagccgccatccaatggacgcgcccggcccacaagccggaaaatccgcccgcccccgcgagtgtcccgccgtcggcggaggctccgcccgctcccgccgagcctagagtttctcgcattcaagccgaatcagaaatcgagaaactctagaaaaacgagctgatgcacttgcgctgagccagcgtcgtgaccgtgtagatggccaatcctaccaggccgccgaccacggtgccgttaatgcggatatactgaagatccttgcccacatggctttccagcttctcgatcaggaacggggtgcgccagcgcatgaccagatcggtgatcagcgagcctatcagctcgcgccggggcaccagcaaggcttcggtggcgtcgcgcagccagcggttcagggtcgcccgcatggcggtgtcgtgctccagccgttgaccgatctcgcgcaggccgttttcaaggagcatctccatggtcttggcctcctccatcaggtggtcgtaggcgctgcttcccaactggcggagataggcatccagggcgggatcgtcgagaacctgcatcttgacctcctcgatccgctgggcaaaatgcggcgaattggtcatgccgtcgatggtttcgtggacgaagagctcgaatttcagccgccagggatggtcgggggcggtcagctcccccagtgagccgtcgatgccttgggtgacgccctgtgcgatctgggtctccacccacagcggcagccattccggacattccttggcgaccttggcgcggatgaatgaacggttctgggcgacgaaggagcgggcctcggtcaccagatgatccaagatggcgtggtgatagccgcgccccaccatgtaggacaagatgttggccatgcgcggggcggtgatggcggtatcgaccaccttgcgcagaccgccgccgatggtgctgcgccaccgttgctcgccgattgtatcgacgatgggggggagcgatccggcgatccgggcggcgatcatggccgccgtctcaggccgggccagccagcgccccagccgtccggcggtatcgagttcctccagccgttgggccagcgcctgcgacgccagcaggttgtcggcgacgaaccggccgatggcggcggcgatccggccgtgattgcggggaatgacggcggtgtgggggatgggaagtccgaaaggatggcgaaacagggcggtaaccgcgaaccaatcggcgatgccgccgaccagggcggcttcggcgaaggcccgaaccggcgccagccagggccaggctttctcgccccaaacggagaatgcgaacacagcggagatcaaggcaagcaaagccgtagcataagtccgcatgcgggaaagtccggcatgttgcgttcgattatcgttatcttctggtgaagagagcatctgatccgaatccgagggtggcggcaggaaatcgagactttttgtttcgagcatatatacgcaatccgctgcagcggcggattacggggtaccttcgtatgaaccctgtgtttatgtgttgtcaaccgcccccgactcgctgttatagtctgaccgaatcggaggtgacgggtgtctcgagtggaagcggctgcggcagaagttaaagtgcgccagcacaacgccctttatttgctgtcggcgttgtgcatggttttcatgaccctggtggttgctattcagccgctattcttgcgaaacgttcttaatatctcattcgaaaccgccggcgccgtcaatgccaatgtgcaggtggtgaccgaggttctggatctcttcatcttcgcctatctcggctacctgtcggatcggatcgggcgggtcaggatcatcgtggccggttttctggtcgccgccatcggtgcggtgatcgcgccgctcagcccctggatcggcggtgcctccatcggggcgctggtcgtctattacgtttcgcgggtcatcatgtcggcgggcagcggcgcggtatggcctcaattgtcggccctggccggggatttcagcgacgacgacacccgggcgcgcctgatgtccaataccgcgttcatgatggccttcggggtgacgctggtctacgctgttttgatgcagatcccggcccatgcgggcatcgccgtgaccatgctgctgacggcggcggtctccctggccggtgcttggctggcggggaaattcctggtggatgtcgctccgcgcacccaggaaacctcggttccctggcgggcggtctggagcttggtgaaggcggagccccgcctgcgcctggctttcgccagttcgctgttcgcccgcagcgacatggtgttcgtagggctcttcctcatgctgtggttcatctactttgccgatctgatcaaggtcgggcaggccgaggcggcggcgcgggccggaatcttgatcgggctgatgggggcggtggtcatgctctcgatcccggtttggcggtcgtttatcgagcatttcggccgcattcaggcggttctgctcgggatggtgctctccgccctgggattcataatgttgggtttcatcatcaatccgttcgactggttcatcgtactgcccatcttgttgattgcgtccgggcaggctggttgttttgtggcgcctcaaatattaacagttgactacgcgcctagggatttgcttgggtctgtgcttggcgcatttaatgttattgggtgcattggtattattttctttgttcaggtcggcgggtttttatttgattatgttggcccgccggcaccttttgtctttactggtgttggaaacttgattatatcggcgtatgcattgcgcctgctaaaacgcgaggcgcgtgacggcggcggcgacgacgccccaggggacgacggggtggcgtagcgccattcgctctgcatcaagactggagtaacgtttatgccaagcgtgattttcggactgctggcgcttgccctcggattgctgggggtgacggcatggtggtggtcggtgaccgagttcctgcgcggagcggtgccggtggccctgctcatccttggcttggtcgcgttggcctccggggtgcaatccgtgcggttgcctcgttccaacaaggggaccgcttcagaccctgacatcgatggttgatggccatgttcaatggtgacgtagaagacggcgggcgcggcgatgcttcctgcggcaaggatctgaagcgctatctgatgctcatgggcgtggttgccctggtcgtcctatttggcgccttcatttaccggcagtcctcgggcggtcttcgtctcggcgccatgttggagcagatggggcggggcaccggccctgccgtcaatgttccggtacagcagggcgggccgtcggcagccgtcaatccggccatgtcggttccggctggtgcccgcgtggcgccgccctcggccgccggtgctatagcgaccatgcctcccatggtggatttcggaccggctcccattggggccggggggccgttctccagcgtcgtcaccttgctgcgcaacagcgtcgtcgccgtgaccgcgtcatcggccaacgggcaggccatgcccgatcccctgggcttggccaaccctgacggactgccccatttcgccaatcccgccacccggtcggtggaaaacatcggcaccggcgtgatcgtccgtaacgacggcttcatcgtcaccaactatcatgtggtgcgcggcgccaattcggtgttcgttaccgtgcaggacgacgtgggctcgacccgctattccgccgaaatcatcaagatggacgaggctctggatctcgccttgctgaaggtcgcccccaagacgccgttgacagccgccgttctgggcgacagcgacggggtgcaggtcgccgacgaagtgatcgccatcgggactcccttcggtctggacatgaccgtcagccgcggcatcatttccgccaagcgcaagtccatggtgatcgagggcgtgacccattccaacctgctgcagaccgacgccgccatcaaccagggcaattccggcggtccgctggtgatttccaacgggacggtggtcggcatcaataccgccatctacacccccaacggcgcctttgccggaataggcttcgccgtgcccagcaatcaggcccgcctgttcatcttggatgaagtgggctggctgccgacctccaccgccgagggggcctccatgggcctggtggccatgcagcgccccatgggcggcggcgtgggcgcggcgggtccggccattttcgccgggactagggcgccccacaccgatggccgccagaacatggattgcaccacctgccacgatctgattccggccggaaacgggcggcccgcgccgatgatgcccatcgccgccccgattccgccgccgccgattcccatgggcgccgtctcgccccataccgacggccgtcagaacatgaactgcgccaattgccatcagatgctgggcggtgccgcgcccatcgccgcaccgggactcggcgggggggcttaccgcttcgcgcagccgccgggaagcctggccatcaatattcaggggccgcgcggcgggcagtcgaccgccgccggaaccggccgggtcacgcttttgggcgccgccttgactcccatgtcgcagcgccttggcgcccagaccggcgtaccggtcggacgcggagtgttcatctccggcgtcacgcccaatactccggcggcgacggcggggctgcggcccggcgacgtcttgctcaaggtggacggccgtcctgtccgcctgccggaagaagtctccgccatcatggtcgagatgcatgccggacggtcggtgcggctcggcgtcctgcgcgatggcgatgtgcgcaacatgaccctggtcgcgggacccgccggtctggccgccgcagcggtccaggctccggccattgccgacatggcgcagccgcccatgggcggcatggcccccactgcacccggcatggtcgcggttcccggtggtccggccgtcatgccgaagcctccgaccgagttcaactggctgggcatggagatcgaaaccttccaggcgccgcgtccgatcaccggtgtgccgggcgccgttccggttcccggagccaagggtgcccaggtggccgaggttctggtcgggtcccgggccgccgtggcggggctccaggccaatgacctcatcctcgaggtcaataatcggccggtggccggtccggctcgtctcgacgccgccattaagggggcgacgaatgccgggcagcagattttgctgaaggtcaaccgcaatggccaagagttctggattgtcctttgatggtggagctggataatggcgaataaccggcgagatcgcgacaaaggcgacgggagccagggtgaaggcttgtcggcgggcggcggaatgccgtcggagcccgagatcgtctcggtgacggtccatcccacgccaactttggccgtgtcgctgaagccggcgcagcaaggcgatatttgggccagtttgctggaaagctcgccctggtcggccaatcacggcggccggatcgagccggttcagccgagccccgcccctacccgccccacggaatccccgtccgtcggcgatctggtcagccgctggtcgcagccgatctggcggacccccagccgcgtggaagaggtcgagaccccggagagcaatttcgtcatcgagttggaggcgtcccagccgatcacttcggatatcacggtgtccgtctccgatctggtgatcgaggttcagccgatccagaccaccgaagccgagccggagcccgagcttccggtggccgagcccgagcccggagtcgtgccggtggacgttgtggccgaagccgagccggagcccgagcttccggtggccgagcccgagcccggagtcgtgccggtggacgttgtggccgaagccgagccggagccggagcttccggtggccgagcccgagcccgaagtcgtgccggtggacgttgtggccgaagccgagccggagccggagcttccggtggccgagcccgagcccgaagtcgtgccggtggacgttgtggccgaagccgagccggagccggagcttccggtggccgagcccgagcccgaagtcgtgccggtggacgttgtggccgaagccgagccggagccggagcttccggtggccgcgcccgagcccgaagtcttgccggtggaggttgtggccgaagccgagccggagccggagcttccggtggccgcgcccgagcccgaagtcttgccggtggaggttgtggccgaagccgagccggagcccgagcttccggtggccgcgcccgagcccgaagtcgtgccggtggacgttgtggccgaagccgagccggagcccgagcttccggtggccgagcccgaattggttcatgaggcggctgtttccgagccggtggccgaaagcatcgaggacgcggtggcggttcccgccccggcgactaatttcggtcttgccgaactgatgcaggcggctgcggccatggccccggttttggcctctcccccttccgttgccccagcggccaagcccgtccgagagcccgcgaagaagaggaaggctccgccggtcagaaagaaggtcgccacggttcaggacgttcccgtcgaagaccttctcggtggaattttcgggatcgccggttcggcggtgcgtagtgtcctcagtcttggtgccggggtcgtcggcggcgtggtcaagggggggcgtgtcattggggacaacgtcgtcgccggtgcgcgtcggcttacggggtccgccgagggaagttgcgggacctgctccacgtctcaatgcgatacggtgggcaagaaaaaatagctggcagccgtcaattggtcatttagcacgcgaacggagtgacaaaaatgagtgaaggtgaaggccaggccaagaacagattgttccttggcatcgaccttgggacttcccatactgcggtgatgtcgagccggggcaaaaagttcctgctgaagtcggtggttggatacccgaaggacgtcatcggtttgaagctgctcggccgcccctatgtggtcggtgacgaggctttcgagatgcgctcctacctggacatccgctatccgctccaggacggcgtgctgagcgagatcagcgaccgcgacatcgaagtggcgcggcatctgctgacccatgtggtgaagtcggccgagcccggccccaacgacgagatctgcgccgtcatcggcgtgccggcgcgggcgtcggcggccaacaaggcgctgctgctcaagatggctcaggaggtggttcataccgccctagtggtgtccgaaccgttcatggtcggctacggcctggacaagctgatcaacaccatcatcgtcgatatcggcgccggaaccacggatatctgcgccctgaagggcactgttcccggccccgaagatcaggttaccctgaccaaggctggcaactatgtggatgagcggctccagaacgccatcttggaacgtcatcccgaactgcagatgaacgtgaatgtcgcctgcgcggtgaaagagcagttctccttcgtcggcacccccaccgaggttgcctcgttcgagttccgcgccgccggcaagcccgtgcgcgctgacgtgaccgagccggtgaagatcgcctgcgaggcgctgatgcccgacattatcgaaagcatcgagacgctgctgcgttcgttccagcccgaatatcaggccaccgtgcttcaaaacatcgtgtttgccggcggcggctcgcgcattcgcggattggcggcctacgtcaaggaaaagctgcgtcccttcggcgatgcgaacgtgacctgcgtcaaggaccccactttcgacggttgccggggcgccttgcgtctggcggaagagcttccgccgcagtattggcgtcagcttggagacgtctccggctcgtgacggggggagagttcgatatgcgggacggggatacgcggcagtctaggacagtggcatggtaagattgatcggatcgttggtgttcggcgggttgatcgtgctgttggcgtcgtccaacgcgcatatggtcgaaacccgcctgggaccactggcgatgattgcgccgcatttcgttgttctgggcataacgttttttctcggtttcgccatcggcatcgtctcggtgctggcgaacgtcatgacgcggcgcaagcagaagtcgccggggaagagcatcgtcatcaagcgctgaatcccttcgcttgggttgaaggcggggtcggggctttggagtgagtaaggatgaggaagagcggttgcacggtctgcagcaggagcatcggttgggtcggcctggctgtaaacaccgtactgatggtcatgaaggcgttcgtcggtctgatcggcggatcgcaggccatgctcgccgatgccatgtattcgctgaaggacatgctgaatgcgctgatggtggtcatcgggaccaccatctccagcaagccccttgacgcggagcatccctacggccacggcaaggtcgaattcattctgtccatggtggtcagcgtcgttttcatcggactgaccggctatctgctggtccacgccgtccagatcttgttggatgaaagcatgcaccgcaccccgcatctgatcgtgctgtgggcggcgctggtttccgtcggcgtcaatgtggccatgtatttctactcccgctgcgtcgccatcgagaccaacagtcccatcatcaagaccatggccaagcatcaccatggcgacgccaccgcttcgggggccgtggcgctgggcatcatcggcgcccattacctcaacatgccgtggatcgatccggcggtcgccctgtgggaaaccatcgacctgctgctgctgggcaaggtcgtcttcatggatgcctatcgcggcctgatggaccataccgcgggcgaggcggtgcagaaccgcatcgtcgatacggcggagcgggtccccggcgtgcgcggcgtgatccatctgcgcgcccgctatgtgggccaagacatctgggccgacatgatcatcggcgtcgatcccgagcatacggtggagcaggcccacgacatttgcgaggcggttcaggccgcggtctgcggcaagatgcgccgtatcgaatcgctgcatgtcagcgccgaggcgcgagaagccggagatacaagcaagccgacattctcggaagaaccgctgacttacgatgaagtcatgttgtcgaaggtggataactagatgatcggacttctcacccttgccgtgttcgtcgcgacgttcgccgttatctatcggtgggcggagggcagccatctggccgttctggccggggcggcggcattggtggtgatcggaaccatcagcggcagctacacgccggtcatggcgctgcgctccgtctatttcgagactctggccctgatcttcggcatggcggccatttccgccctcctggcccgctccggcgtctatgcctatctggcggccggaacggcggaactgtcccagggccaagggcgctggatcttggtgatgatggcgctggtgacctacgggatttcgctggctagcaactccttggtgacggtggcggtggtggttccggtgaccttgacggtgtgctttcgcaccggcatcgaccccgtgccggtcatcatcgccgagattatcgccgccaatctgggcggggcctcgaccatgatcggcgacttccccaacatgattctggcctcggcgggcaagcttcacttcaacgatttcatcgccgggatgatgcctgtctgcctgatcttgctggcggtgatgctggtattcttcgagcggcgtttgggcgactggaaaggctcggaaattccggtggatccggtctgggcccggggcgaggcgctgcgtcacagtgccatcgaccgtcggcttttgagttatggactgatcattttcggcgtcaccgtcgccggtttgattctggcggggccgctgaaggtgcggccgggctggatcgcctttgtcgccggggtgacggcgctgggtctgggccgcttcaaggatgacgagttcttctcggcctgcggcggcaccgacatcttgttctacggcggcctgttcgtgatggtgggggccttgacctcggtggggattctcgactgggcggtgaactggctcgaaggcattaccgccgcccatgaccgcgtccgcgccatccttttgatgtggatggcagccgccgtcactattttcgtgggcggcggcacctcggcggcggtcttcgccccggtggcggcgacgcttcgcctggacggggacggtcaggcggcttggtgggcgctggcgctgggcatcatggcggggtcggtggctgcgctgccgggcgccacggcgggatccctggccatgactcaatattccggcttcgtgaagcggcatccggaactggcatccgcagccgccgccggtctgcaattcacccatcgggaatatgtccgctggggcatgccactgatggggatcttcttggttctggggaccgtctatatcgcggttctcgtgggatgagagatgacgacaggaatccgaatgagcttggaactcagccatgattgaagtcggcgagaccatgggcgaattgcccaccaacaagatcgtgttttgcgaacggtcgtggaagacgcctgtctcgatcctggccttcttgatcttcgtgaccttcgcctgggggatctatctcctggaccattacgacgaggacgacaatttccacggggccgacgatctgtcggtgggtcagttcctggtgcgcaacatcgccatgccgcatgtgcagcggctgtatcacacggttccccctgctgtggtcggggtcggcggcggcggggtcaatgccggtccggtggcctcgggggccatcgtggggaccaacggctatgtgatcaccaccttgcattcggtgtccaagctgccggagatttcggtccaggtggcgacgacgggtgggatcaggcgctttccggcccaggtggtgaagaccattccggggcatgatctggcgctgctgaagatgcagaccaccgagaagttcctgcatttccgcatggccgacgtccagacggtggtgccgggtcagcaggtcttcgccttcggccgcaacatggcgggggcgccgctggtgcgccagggcctggtgcaatcggcggatgcgccgctggcggtgggggcgacccagatcacccatctgctgcgttcggacgcggtctacagctgggaacagaccggcggcccgctggtcaatgcccagggtgatctggtgggcatcaacatcgccgctaccggccccaccggcaaggtggaaggcttcacggtgccggcccaggtgatcgtgtcccatcttcaggacgtggttcgcttcaagaagggctccgccacggcacccggccaacctcagacccagaccgtcgctgccggttccaccaattggtggtccaaggcccgggcggtggtcgggggaccgactgccattccggggatgggcatgaacgtcgtgcaaggcaatgtggtcaagggcaatgtcgcgccgtccattccctcgggcatgcccttcatcgacacagaccatgtcgggggtgcaaagatcggcggatactccgtcgccgatatcgtcggcctggtcatgctcgccttggcggcgggtgtcaccggcggcatgatgaccatgggcggcggcgtgctccaggtcgccggcatgatggtcttcttcggctatggcatgtatctgatccgcccggtggtctttctgaccaatgtggtggtgtacggtgctgcctcattgcgcaacgacaaggctcaactggtccagtgggacaaggtcaagccgctgattccctggggcatcgccggcgtgatcctgggctatttcatcggcaacgccatcggcgattctgtggtgggtattctactgggcctgttcgctctgatcatggcgggcaaggcggtcatggaaattcttcagcccaatgccggcgaggaaacggccgagtccatttccgccacagaggctgaagacgagatggacgaattgatggctttggcagacggcacctccaggcccaaggccagcggccttgccttgccggaaggccatgcccgttcggcggtgttggggctgcccatgggtctgttcagcggtattctcggcatcagcggcggcgtcatcgaggttccgctgcagcgctatgtgggacgcatcagcctgcaaaacgccatcgccaacagttcggtcctggtgttctgggcctcggtggccggttcggtggtggccttcctccacggatccagcacgggtctgattcattgggaagcgccggtgaccctggccctggtgatgattcccggcgcctatgtgggcggcatcatcggagcgcgcctgatgcgggtcttgccggtgcgggtgctcaagggcgtgtatgcggcgaccatggccgctatcgctctcaagatgctgacctcggtgtgatgatcatgatgctgggattggccggacatgaatagcaaggtggcgcttctggtcgtgggactggccgttgttctggcgctcgtcatcgggcggcaggggccggtcgcgccccaggccacgaatacgcagtcccaggcggtggcagcagggccggtcgcggcgcctgtggcctttccccagcccctgtatccccaggcggccaatgttgccatgccggtggagcccgatcctgcggcgggcggcgggaccgcgccggcgacggaatcgccgctgcccaacttcgttccgcgcaagctgaaggtgttcgaagggcattggcagggcatggacggtcgcctgatgaccgaggaactggcccgcaagctgaactatccgcgcggcctgcagggggttttgctgggcgaagtcacgctgaacgcggcgttttccgggcttttggccggcgatctcatcgtcaggatcgacgataccccggtcaccgacatggagagtttcaaggccgccagccggaccgtggccaaccgctccgatgcgcggatcagcgtgctgcgtaaggacaaccggccgggggctccggtggtgcgcaagctgacggtggtcctgcgcgaggccgagggcggcctgggcttcgcccagttggaaggcgcgcccatgatcctggcgggcgatccgcgcccccacggctatcgcggcgcctgcaccgattgccaccccatcggccaggggttcgagttgacccccgacccagatttgataagcctgcccccgccgacgatcacgcgtgatatggtcgcccggagcgtcaatcctcacgaagtgcgcgggccgtgcgaagcctgccacgtcataaagtgatcagagccacctgattaggattttggagaacactatgtctagcaagccgtcggatattcttgacgaggtcactctttacgctcactacggcctttcggtggcgaagaagctcggaatgaacatggtcgatgcgttccgtgcggccttttccgtcaacgacgacatccgccaggtgtattaccgcgacaagggcatctcccacgccaaggccgggcgctattcccaggccgtcatgctgctggagcaggtctacgacgccgatgccttcgatgtggatgtggctctgcacctgggaatcgcctatgtgaagaccggcgccgtcgatcgcggcaccgaactactcgaacgttccttggccgatgcgcccgacaacgtgaaggtggcgaccgttctcggcctgacctatgtgcaggtgcaaaagtacgatctggccgttccgctgctgatcaaggtggccgaggccaatcccatcaatttcaacgtccggttccgtctgggcgtggcgctggacaacctcggccgtttcgacgaagccatcgacagcttcaagatcgcgctgggcctgcgtcccaatgaaggcaaggtgcatcgcgccatcgccttcagctatgagcagatgggccggcacgaggaagccttgccgcatttcaagaaggccaatgaacttgacgaaggggcctcggtctgaggccgtatgtggggcgtttccttcatacgacgagcttagagaggcggatatggcattaggcgacgcgaatgttggttcggcccctggggtcgacttcagtgcgctgcaacgggtgaagcagtcggaggagctgcttgcccagttgtacgtggtggaggagacgccgcgtcgtttggggcgtgggccggtgcacgctcttatggtcatatcggttttgtcggttgttgcgttcatcgcgacgttgctgatgcgctacaacaccttcgtgaccatgtcggaagacacgcaggcgaagcggtccaattacgaggtgatgatccagcgccgggacaatctgttcggcaatcttgtgaagctgacgctgaaccatgctgcattggagcactcgatcttctcgcatacctcggacaagcggaccgagggcgttgaggctggcaagggcggccctatcggctcggcgctggaacagctgatgaagcagggcgggatcggcaagcttctgggtgatattgggggcggcaaggcgctgctgggggccgacggaggcttcggcaatgcgctgggccgtttgatggcggtggtggagcagtatccgaccatccagtcggtggacacctacaagcatatgatgacgtcgctggtggagatggaagaccgcatcgcgacgcgtcgggaggattacaacgccgccgcctcgacctacaacatcgagatcaccaagtggccgtggaactatctggcgttcatcaccgggttcaagcgggcggagtatttccaggaaaagccggcgggcgacacgccgatcatcacgccgcagctgttccaggaactgttgcctctcaaccatgcgcaggacatcaagaaatgatctggacggcggtgatcaaggggagcgcgctggtgaccttcgtgcagggcgccatggtgctggtggacaagatcttcggcgaggagatcttgccgcaccggatctacagcagcgcggaagcctcgcaattgctggggatggaccgtctcgaggtgctgggcctgattcgttcggggacgatcaaggcgaagaaggtgggcgataattatcgtatcctgggctccaatcttgtggattacatgaaccgatgaagttcgaaaattgcagggattgccgcgaggaagtggtgtggtgggcctttaccgccgacatctgcatgaccctgttcaagggggtcctcgggctgatgagcggcagcgtggcgctggtggcggattcgttgcattcgggggcggacgtggtggccagcggggtgacccagctcagcttgaagatttcgaacaagccggcggatgagcgctatccgttcggctacggcaacatccaatacatctcgtcgtccatcgtgggctccttgctgctgatcggggccagcttcttgatgtacggctcggtgatgaagctgatctcggggacctacgaggcgccaagcatcttcgcggcggttggggcgtcggtgacggtgatcgtcaacgagctgatgtatcgctaccagatctgcgtgggcaacgaaaacaacagcccggccatcatcgccaatgcctgggacaaccggtccgacgccatctcgtcggcggcggtgatggtcggcgtgatcgcctcggtgatcggctttcccatcgccgacaccatcgcggccatcggcgtctcggccctggtgggacgcatcggcctggaactgatcggaacctcgatccacggcctgatggacagctcggtggatacggaattgctgcagaccgcctggcaggtggccatggacacgcccatggtccacagcatctatttcctgcgcggtcgccatgtgggcgaggacgtgcagttcgacatccgcctgcgggtcgatcccaatctgcgcatcaaggacagttccatggtggccgaggcggtacgccggcgcatccaggaggaaatcccccacgcccgcgacatccgcctgttcgtcagcccggcacccgccgccgcggcacgggcctgagcgagagaggggcggcgtcatggacatccggccagagcgtatgttgagccgtattcggcagatggccgaaggcgccgtctcgccccagctggtgctcggcctcggggtcgtcctgatcctggggctggttgtgagcgccatgcttcccgaccgcttcacaggcggcggcaaaaccggcggcggcgtcacggcccaaagccaggcattgtcgcttcccgccgccctgccgggtctgtcgccctttaccccggcgacgcctttgcagttcagcggccgtgtcacccaggtggccagcatcggcaacgatgtcggctgggggcaggtccatatctggatcgacaacggcaccggcgccctgcaggagatttcggtggcgccgcaggcatatcttacccagatcggctgcccgtccttcgacggagcgcgggtcagcggcgtcggattcatcttcgatccggggcggcccaatgccgagctttacgtcaagtcgatccaggtcggcgggcggacctgcaagttgcgcgatgacgagggactggcactgtggatggtggtgcagtgagtccgaggagacggggaaggtgagcatggaggcgccgcggcgcggccgtcgctgggtaagcttggggatgatcgccttgttggcggcgatcgggctgggactctattgggaccagctgtccacgccgtccggcataacgcccgccacctcgccccgacgggcggaggggctgctgctggggcgtctaccgctgcccatggagccatcgctgctgtcgccgttggagcggctgctggaaccgccgctccgctacaagctgatgaccatccgccatatcccgccggtgaagccaggaaccggaatgccgcatccctatgtaggcgattgcatccagtgccacctgatggtgggcggcccggccgccggctcccagttcaagacgccctatggcgccgttttggaaaatctctcgcgggtccgcaagctgggaccgcccattctgccgacctcccgccagccgcatccgccggccggacgatgcatcaaatgccacgacatcgtggtcaaggtgccggtggacaagaaaggcggcatgagatggcaattatgatcgcgggcgccattccccgctgaccagggacgggacggggcggagcgatgcgcatcgcggcgatcatcaatgaacgtgcgggaaccgtcgcctgcctgtcgcccccggtcgtcgccgcccggctgtcggccatctggacctcgctgggccatcaggcccatgtcaccctggccgagggaaaggacatggggcgcgcaattcgcaaggcgtgccgtgatcccgccgtccatgcggtcatcatcggcggcggcgacgggtccttgtcccgatcgcttaagcatgtggtgggaagcggcaagtccctgggtgtcctgccgctgggaaccatgaattatgtcgcccgccagttcggagtgccgttcgaccttgaccgggcggcggtggccttggccgatgcggttcccacccccaccgatttggggcgggtcaatgaccgtttcttcctgattcgtgcctgtctcggcgcatttcctgaattcatccgttctcgcgacgaggcccgccgcaaaggagggagctttctggacggagccctggccgggctgaccggcctggcccgggggcatcgcttgatcgaagcggagttgatcggacccgacgtccaagcccggatcgccacttccttttttatggtgtccaacaatatgtgccgggattccgatccgttccagctggagcgcgagcgcatggatggcgctaccctgggggtttatatcgggcagggggcggggcccttcagcctcatggatctgggcctgcaggtggccatggggcgctgggccagcaacgaggccctcatccgaggctccttgccctggctggaaatccggacccggcagcgcaagccgctggtctccatcgacggcgaggtggaaaagatggaagcccccttccgcttcgacatcctgcccggcgtcctacccatgctggtgcccaaataatcgcggccttgcaaggtggtgcggttgccatggacggcaggcaactgctatagaataaaccacggtgcgcattggcgtcgccgatgctgggaaggccgatgaaaccaagcaaatgccaggaatgtcgtgaccgagcggcttggctggacatgttcaccgccctggctctcgccgtgttcaagaccgctttgggggtgctgagcggcagcatggcgcttcaggcccattccctgcattccttcggcgattttctgaccaagggcatcaatctggccagcgtcaagctgtccagccgaccggccaattccgcctttccctacggctacggcaaggttcaattcctgtcggccaatttcatcggcatcagcttgatggccggggccgccgccatgctgtggtacaacgtcacccatctcggctccggccatgtgcaggtccccgaggtctgggccgtgttcggcgccctgatctccgccggaaccgccgaactgatgcatcgctatctgcgctgcgtggccgaacacaccaacagtcccgccataatggccgccgccgccgacaatcggggcgacgcctattcgtctctggcggtactggcgggcatcgttttgtccatcctgggatgggtggcggcggatcatctggccgccatcttggtgtcgctgctggttttgcgcatcggcgcggtgatcgcctgggacagcatccacggcttgatggacggcagcgttccctcccatcgcatcgacggcatccggcaattgctggccgcccaccatcccggcgtcagcgtcgtggacctgcgcggtcgccgcatgggggaaacctgggaagtggatctgcagctttccatttcaagccaggtcacggtcgaggagtgccatgccctgacccgggaactggaaagcaggatcgcccgggaagagccgcacgcctgtcacatccgcatccggtttattccccaatctggggatgcgacaaagaccgccgtcatcgagacggcggcggcggtggatgaattcgcctatttggttgaggcgtccgcggccctccggccgcttggccacagccgcaatggcggctgatcgcggcgtgcgccggatttggcgctcgccgctatagggaccggggccgctacgctgttggcgattggttgaggcgctggaaggcggcctcttgggaatcggcggcgcggcgctcttgcaagattacatccgcatcgttcagtcgcttggcggccacaagcttcagcggtgcggcgtcatccttttccagctcgctgagggtatcgtctcgggccgtcagcgacagcacgttctgccatccggtcttgatcatctccaacaggtcgagggagagcgaggggtagccgccgagcattgtgatcaaggtgtcgaattcggacatcttgtaaaagatcttcgacgacgctcccaatgcggcgggggtggttccatcgacgatccgagacgattcctggacggtccgttcgaggccggaggccaggattcccaacgagaacttactgacggtccgcatgatctcggcgtatttctttttgaagaaggaccctgcctcgccttcctcccggcaatagccgtggaccagccccatgaggttcatcagacgattgaaatggtcgctgatcttcgccttggcgttttcctcggcggggtcgtgaagcagggcttgaagctcttgagagatgcgcagggcctcttggacaacctggacgcggcggttggacggtggcagatgctcgatatcggggcctcggccgccgccggatgttgcggccatgccgattccggcggtggctttggacggcggccggcttggcgtctcggcggtcgcgccgctcggcgcctcggcggcattttcgggccgggcggcggcggacggtttcggcggcgcggtttccgccgccgggcgcggggccgtcccatcggtggcgcggcgacgcggtccctggtagttgggaagatcgttccgcctgcggtcgggaccggcatagccgccgcaattgatgaattcgcgcgagtcggtgagaagcgccgagacggctttcagcatcccccgcagagtgagggggagggtggcgaagccggaggcaccggcatcccgggctcgggtcagacgctcattatcccatccttccgtgacgcacaggaagggaaccgtccgggctctgggggacaagtcgcgccggatatgcttcagcaggtcgatgtgaccatcgccggcctccgcccaaatgacgagatcgatggtggtgtaacgaagctgtaaagtggcatgttcaaccgtatcagtttcgtgaattacactaattccaatctgattaagaacgtcggccagtagacggcgctttttcttgtctgatgaaatcagaaggcatgcaaggttcttaaatgatggtagagtcaacatgcattaactcataagacggcggaattgtatttaatgaaggggtggtagatacagtggagaattcggtgtgtctgccccattccctcgccctcatctctcggtacgccgaaggaggggtcgcttggtggcaagcttattccgtatgatgtgccgagtccatgggaggcgaggaaatcgtgttcgaaagatggaatggcccggctggccagctcaacctcggcgcaaaaatagccagtaaatctcataattcgagggttgtgctgcggccttggcaatgcttcgatacacacctgatcggtggcgttcgaaaaggggtagatcctcaagatgaagccatttgctgcctgtaagggccttgttgttatcgcagacggcggcctgcgcagggtgctgcgtgagttgttgcttggggtaaagatgcatgatgtcgaatatctttccgatgtcggaggggtagcgcatgcccttcgcgccaatccctctatcgacctgatcatctcccaaaacgacgtaccgggcggcgggagcattgccatcgctcgctttgtccgttgggaaatgtccgctcccgccaatacgcttcccatcatcagcctgggccgggactggacgccggaactgcttcaggaaacccgcgaggccggaatctgcgaggtcatcgccatgccgacctcgctgatggcggtgcaggcgaagcttttatccgccatggacggcaagcggcctttcatttccaccgccacctatcgcggcggctgtcgtcgtcgccggtcatccaagggtcaccagggaccgttccgccgggccgaggaccgcatcgccgagcagctaaatcaggcggtcgagaaatcggaacggcgggccatccggcgggaattgcagggagagcgttccttgccgccggtgcccggaatggcggcggccgcgccgcagaggggctctttcgcggcgccagcgcgtcccagggcggatgaggccgaggaggacgaagggggcgaccgccagacccgcgcggtgatcgacaaggccttcgtcatcgcccgcctgatcgagcagcttctggcgcggttggtgaccaccaccggcgccgaggcgcagggggctctgaccacggcggtggccgatgccgaagagcgccttatcaacctcatggcgctggcgcagatgcgcatcgagcagcacggctgctccgcggcggatatcgagcgtctgcgcattatccgcaaatcggtggatgccagcgcggaatcgcttctgcgcgcccacctttcccggctgatcaagtccggcgaggacattttgtccgggcgtgccggactgtctttcaatatcggtcgcgccatgcaggctcgcatgagctatgcccaattcctgatcaatgtccgcggcggcatcgacatgctcgacagcgaggtcaaggacgcggtcaagaaagcccaaggcatcgtggcccaggtgaaggaaatcgaggcaggggtgttgcccttgccgcagttcgacaccgcccgctcgccgaagtcgcagacgtccggccgttctgggcctgcgggccgctgatccggtttcggcgccgaattcggcgcgatcggccccgtttccgaaccatagaagatgacgtatttttccccttcggctatgattgccgacggtttgccccggcctatggagaccgggtgctttcgcccggggatctcggcgcggcccatgggtttggaaagcggctatgctgacagcgatcatcgccggtattttattgtttctgttcggagttctcatcaaaggcgtgttcgcgcacgccatggtgattctcgtcgcctggttggccaagaacggcctgctgctggcctttctccggacccgtttcgggcgtcgcgtggtccggaacgcacggttcagaacctatgcccaggtagggccgggcagcggacggcggcgagcctatcaggtcttcaagcggatggcgggggccgagcgggcgacggttcgcgtcctgacccgggtgcgcgatggtttcgccctgatgatccgccgccgccccaatacggcggtggtgccgcaccgcaagaatccgtcttgaggggggcggcggctagtgtccgtccctctgcctgagcgcggccctccagccgcttggccgctcgctcaatgctcgcctgagcgtcgtgcctcatatttgaggcacgacgctaaagcagccgccggacgttgatcttcagggcttcggcgatcttgcgcagcacgatcatgtcaaacccggcttccagggcggccagcgtttcgaggctgattcccgccgtccgagccagggactcgcgggtcatgccgcggtattcgcgatagacttggaccgggctttgcccggccatcaaccggtccgccaccgtgtgggggaactgatcccgatcgctcacggcggcgggggcgcagggctttgggggctcggcaacgggggtggacttcggaggttcgggcgcgcgcggtgccgcctgcggctgctccccggtcagcaggacgcgcatcttttcgagaatttccgccatcttggcgtcccgcgcactgtccgtttccggtgaaggcacccccttttccgtgcccatccttgtctcctgtcttggccgaataccggacttggcgtaagcctcggccccaggcgttaaggttgccgtatgcccccttcaattcgcaaggggtttgataacccggccataaccatgcttcaatgcctatttatcggatacaggctagcacggaatggctttttccgttttcatcggctggttctttatttcctgggatgcggagcgcgcgtggggccaaggatcgtggaatgtcattgaatacctccttcttaggcaaggcatgcatggtcgtggcctcggacgattcgctttgcagcttgatcgcgacatccttgcatcagattggatttgccgacgttttgaagtcgggcatcctgaccgaagcgatcaagttcgccgcgtccggcatctatgacctgatcgtttgcgccggtaccgatatcgacgaaccgctcgacatgattcggcgcatcagaatggaaacccccgaaggcgtcgtgaccgggccgatgatttgcgtcatcagtcacatggatgtcggcaatctgtccatgatgcgcaattccggggccaattgcgtcatgaccctgcccatcggcacgcgcagcatgctgaaaaacgtcaatcgcgccttgaatgaaaagcgcgagttcatcgccaacccgacctttcgggggccttgccgccgcaatctcgctccgggcctttacgaagggccgttccgtcgcgctgccgaccgccaggacggcgcgacgcaattgccgtctccgtctccggccccccgcaagcttgccgccaagggccataccggggagctgggcctggccccgcgccgaccgcatgcgccggccgtcgtgggggaggatcccaattcccaggcatccatcatcttcaatggcgtgagcgaaatcgccgccagaatcgagcaactgaaggaagccctgcatgccaccgatgatgaacggacgcgcaaggtcgtgcgcgccgagatcatggaggcggcagataggctggtgaacctcgtcaccctggtggatttgaacaaaggttcccatcgcggccaggacaatccgctgcggcagaagatcggggcgatgaaggctttgttcatcggcatcttgcggcaaatgtccgtcggtaggctggatgcgatcatcgccgatatggagaagtatctgaacggcggagaaatcgccctgggaggcggcgaccttctgcaggagcgattggcctcggtggaggaaatcgtcgcggttctgggcggacgcaaagccgacgaaaccatgaagcgaaagctggattccgcctgggagggaatcgggaagctccagaaaatggaggcggaacattttgaattggccgatctgacgcgcaacaagcgcagcaagcgcggggcgagccggtttcgtccgcccgccgaggcgaatgacggggtggcaagccagaacggggttgccgatcttttgcgttcgcgtggggagagggggggggagaaggcttgatcagggccgtgggggggcggggcggtcggcgagttcggcgccgagcccctatttcagccgaagtttctgctgtccggccagccgcgtcaccgtcacgggcgttgccgcgggcgacggtcttgccgccgtgatggggaccggggctgatcggggggcggcggcagcgaccggcggcagcatcgagcgggcggcggccacatcggcggcgacctgcttcatgccgcgccgcagggcggcgttttcggatttcagccgcttggcctggagccagttccgttcgctttgttccaggcatatctgcaagatgacctggaggcggagcattttattgtcggcggggggcgcctggacaagggaagcctgggtgtcgcgggctgtttcggaaaagatgtcggcggccacgaagtcgccgccgttctcgcgggcaaattcgccctcctgaatcacggattcggtcaaatgcgccagatgggcgatagcggccatcatttcctgatcggacgccgcgccgggggctccggggatgttgccgcaggcgtccagaattttcagcagaaattcatgggatttctgcaggttcgccagcgctacggacagtatcgaaggatgcgccatctctcaggaccttgtgctgacgcggacaggcccattctgtctgaacccgtcgggatcggcaatcccatccgggccgtccttgcgcacgacggcccggcttatccccaagcccgaaggaggagcatatgccgacggggggctttcttgcctttggctatgagacaagctcggtgtccaggcctgcagccatatacaccagggggcggtcatccacattcgcgttggtcaagatccctttgtattgggcatccaccacccggatatggttgttcagccaatccgtgaccaaatgcgccagggtgccgatcttttcgatactgcccgtctggcggtagtcctgaatgatgcgggttactcggtcggcaaaggcgtcgtgcgccgcgatatgctcgaccagataggcgtagtcggccttggccatggccttttgctcgcgcaggaagtgcccctcgatatattcctcgaggatattgatggaggtttcgatgaggtagggctgatcgttgtcgggcgtggaggtcacgtcgctcatcagagctgccaagcgaaagaacgcctgatgatcttcgtcgataatttcgacgttcacggataaatcatcggtccattcggggagcggattggtctggttcattcctcgtctcacgacctgcttgaacgggcggcccaactacggcaataccccatgccagagtcacatagtcagccagcgcgaccaaaagtcaaccgggatcgccggcaaatccggccaaagtccaagctgcattccaaagccgcgaggcttccgatccgaaccttggggaaacggcccgaaccttggggaaacagcatcggcggcgtctcccgcggggcgaatcatctcgaattcgatcactaactgtagcatgaatcggcccaagggcagagaataaaaataagtcgcaatatttgatgggcggcaacatatctccaaggatgcaacaatcgtttgacgagccccgcccgtatggggcccaattcatggggccatgcggcttttaccggggctcgcaatcgaaaggggagaagtgtggcgcataataatgctttcggcttcgaggagattcgccgggcggtaaattccgcaggatggcttcggctgcttttggtcgtggccattggcctgacggttgcgatcttgttcgtgcatcttttcgtcgcgatcgcggtgggggcgctgtgcatacttttcgttcatcatgcggtccagcgcgccatggggccgggaacccggattcggttgcggatgccgccggcaatgtccgcgcgattgaagggctggatgtggcgcaaatgacggttccagtccgacaagggggcctggatggatgtgtcgtttgccggtggcctattatttcaacctaagcgagcgtgccggcgaactggcccttgggcgcccggttcaatttcctggcctgtgacgtgatggcaatgcacacgctgtccgaggatcgaaagttttttggacaaatccaagcgattcgagatacagcaggacgaacgcaggcaatcatttcgggcgacaatggcaatattcgggcgaaaaactccacccatccaagtcggtgacagattcacaaaggcaaatgaccacaccaggaaagtctgggaggtgtcccgcctttggacggcggtcgatggtgtcccccatgcccggctcgtgaaccagcatgagacgttgatggtgtcggttggaacgttgaatgatcaagagttcttcgtggtcgttcctgtgaagcggaacgaaccgtaaaacagatctgcggtggcgaacgggcgagaactctaccacctaatcatgctggacggattttggggatgggcgggaaatatccatccagatatagctgattaggtgaataccacatccgggagacattggccgatcaatgcatgagggcagagccgaaatcttggtaggtaacttggcggtatatggcttttgaaataggcatgatacctttgctgcgtgaagggctttagtcggacaggcttacgtgctggagtatttgcctatgacctccgctgcacaaccaaatgctgcaatttcagttttatcatttcgaaggctaatggttgggtctgctgcattatggacagcggcagtcttgctttcgttttggatggcggctgaaaacgaaaggcagcaagcagtgcgtttggcagttcaagaggcacgaaccagcgtgcaaacagatattggtttccgccattgggtcgcatctcatggtggagtatatgtggctcctgacgcccaaacttccccaaacccgtatttgaatgtccccgaccgtgatgttgtaaccacgaacggcaaacacctgaccttgatgaatcctgcatacgtgctgcgtcaactgatgcagtcgggatttgttgccaagggacgaattacgagcatgaagcccctcaatccggagaacgccccggatgaatgggagcatcaggctcttctgcttttggagcagggtgagacagaggtaactgaaaaggttctgagcaacggaaaagcggctgtccgtgttatggcaccaatccgcgtcgagcaatcctgcctaacttgtcacggcgatcagggctacaaggttggcgacctgcgaggaggtattgatgtcaccattccattggagaaatccaatgaaattgcgtcaacggagatcaaaagattagctttaaaccatgcaatattctgggctctggtgatgtctggaattggcttgatgtggggcataggtaaatcacatattcggaagcatgaattattaactatacggcatttaataactcaattctcaagagaccgagcggaggaacctgtttactggattaatgaatctgggttgatttcatatgtgaatgattctgcatgttcgcttttaggttatgatgagagagagatgttgaatctacatgcatctgaattaaatccggaccaccctcgtgaaaaatgggcggagcattggcgttctttaaaagaagaaagattcctgcgatttgatgcaactttgaaacgcaaagacggatcgacgcttccggtcgaaatatcggcaaactacctctcccatgaggggcaggaatttgatgtggcttttgttcgagatatgagttcgcacaaggaggccacagttaagattgctcacttgacggatatttatgcggctttgagccaaaccaacaaggccatcattcgcagcaaaagccgccaggaactctttgatgccatcgttcgaatctcggtggatttcgggcattttcgcatggcgtggattggcgtggtcgatgacgcgagccgagcaatagttccagtagcttgggctggtgaggggattgcctatttagatggcctgaaagtgtccgctgatgctgatagtccttatgggcaagggccatcaggacaatgcattcgtgctggcgagcaccgcgttgctgaaaatttctttggaacccagataacagcaccttggcagaagagagcggcgttctttaattttaattcatcggccgcatttccactaaaaaatcagggaaaaactattggtacattgtcactttactcagatgttccggaattctttactgacgacctcatcgaacttctgacggagatgaccgatgaaatttcatttgccttggaccgaatggacctggaggcaagtcatcgtcagcacgaagccgagcagaaagaactggtcgaacgcttgatggcatccaatacggaattggaacgctttgcctatgtcgcatctcatgacctccaagagccactgagaaccatcgtctcttttgcacaattgctggatcgccatctgggcgacaagcttccaccggaagaccgagaaaattttgaattcgtcgtaggtgcagcaaagcggatggggctgctgatcaacgaccttttggcattttccagagtttcggcaaaaggtgtctcgttctcccgcatctcactgacggctgcatgttcagcggcacaggataatctcagagaggtcatttcccaaaatcacgcggaaatcactgtaggccagcttcccgaggtgatcggcgatgatgtccaattgatgcaggtgtttcagaacctggtcggcaatgctgtcaagttccgccaccctgaccgtaagcctcaaatatccattgatgctgagcagaaagacggcaaatggcagattgctgtccgcgacaatggcattggcattgcggacaccacccaggatatttttgagattttccggcggctccatgctggaaatcaatatccaggaagtggcgttggacttgcgatctgcaagcggatcatcacacagcatggtgggcaaatttgggtggagtcagaacctgggcacggagccaccttccggttcacggtgccggtatagatttgggaacgcatagcggcgaggtttgggtcgagcaatcgccgtcaggtggctgactttcctgcttaccttgccgacttctgagtaaatccgtttggttgacgatgcctgttcgtcgtgccattcgttacagccatgcttttcgcagggaggggcaaatgaacaagtccgaattgatcgccgccgttgccgatggtgccaacatgaccaaggccgacgcggcaagtgccatcgacgctgtattcgaagccgtcaccgccgccatgaaatcgggcgatgacgtgcgtcttgttggcttcgggtctttctcggtttctgcccgtcctgcacgtgaaggcaggaatccgcagactggcaagaccctcaccatcgcggccagcaagtctgccaaattcaccgctggaaagagcctcaaggacaccatcaatggccgatgacatcaaggctctgaccactaagatcgtggccgcctacctgagcagcagcaccttggcggccactgaaatcccaaccctgatcaagtccgtttattcgactttagccgctacggacaaccctgcttcagcaccggctgaacagcagcaacctgccgtttcggtgaagcggtcggtgacccccgattacattgtctgtttggaatgtggtgatcggcaaaagatgcttaagcgacacctcacgactgggcatgggctgactgccgacgagtaccgggccaagtgggctttgcccagggattaccctctggtcgccccggaatacgccgcacgcagatcggagtttgcgaaagctgttgggctgggctattcccggacgaaccggaagcccaaatcagccacctgatgaacagggaagggatagtcatgccgccacgtaaggcttccaagcccgcaaccgcccccaagcctgccaaggaagccaagaagactggccggtccaccagaggtccgccacgccatcgtcgaatctgaattcgccaagttggacctgaacctgagacgtggcgtggaaatcagggaagaaggtcgcggcaggggcgtttgaagccggtcgtgccgctggtccgtctctggcccttcaccctggtgtccatgggaaagattctcggaaacaagtaaggggcgtccccctgccaattgaagtcattcaatagcaataatggaatatcttggctgttgttctggggcacgtggtactcattggtaagtgccgattgatggccgcaaattagagcgtcgtgcctcaaatgtgagacgcgatgctcgggcgagcattgagcgagcggccaaagcggccggagggccacgctcaggcggagggcgtacataaggcccaaggaagggggcgcgcgccttacggcgcggggaaggccctgcgactgcaagattggggcgctcgcgcccgcccgccgttgctgagggctctgcgatgatcggttccggtcagcgcagattggtataacgtaaccaagatgaaagtgagaaaaccatgtttccacgaatccgaagggccttggtcgttgatgacgctaagccgatgcgggaactgatcagaatcgctctgggttcctttcattgcctcgatgtcatcgaagtggaggatggtacgctcgcattcggtgccgccaacatcgtcagccttgaagacggcgaattgactgatggcagcacggatatcgttttcctcgactggatgatgcccatgctcgacggcatagcctgcactaaactgatccgttcaggcgggcttgatggctttaatgccgatgttccaatcgtcatggttacggccaggacagaagatgaatgcgagagaacggctttggatgcgggcgtcaccgtttttgtcaagaaacccgtctcacttcgctcactttccgccggaattgctgaagccctgaccaaaacacctcagaaggtgctggcgtagcttcccccttaaaaagggaagtgatcgaaaagactgtagggcatagaataccgcagcgaatgtcggcttgatcggcagcgaggacgatatgctcaagctcacgcaagatatgatgatcggacacccgattattgacgccgatcataagaagctcattagcataataaatcaattcttggtaactgcgaaaatatgcgaaacattagagggggaagttgatgggcagaatgaagctgcgatgcatgtgacgctgaagcagctaattgcctacactcacgaacactttgagagagaagaaaaaatacaaagagagtgcatgtatccatatttcgacatgcacgccagagaacatcgcgttttgaagactcagcttgaggaaatggcatcggcctatttcatcacgaagtcgaggatggtcaaccgtcaatcacttaacgaaatgagcgaatttttaagaatgtggctgtttaatcatattatgaagtttgacatgaactacagagactgggtttgcccaaagggtaattagggcatctcgaaggctggcgttgctgtttcgctatttttcgacaatatcaaagtcctgcaaagacgcggctgatccgagttccatttccaagattttcccggccaactcatttgcctcgatggctgctgattttgcggtggaactcatagcgtccaatccaccgattaccgcagccaagcttgccacccggcccatttgtcgccgcaagatatccccgatcccaaggggaatgccctgcttgccggacaaaatatcactgcaaagccgtacgattttttttgcagccgtcacggccagagaatccgcacttttcgtcagtgcatgccgtatctcgcccagtcgtttaagctgaaaattagagcacccgctcacctgtacacgagaatccgcaagctccataaggttaatcaatctctctgttgatgtcgaaatatcatacagtatcctttttttatgactatcatctgtcgttgagcttgtctggaggttgacgttcataattcttgccgctaactcatacgcattttctatcacgatgccagtttgcttgtgtacagtctcgctgccaatgccatcatcatattcgccattcatcttggcgatcatgatgcggtcaatgctaacaatatgcgtgacaagccaattatatattataaagaatagtttctcacttccgctgccattatgaaggtcatcgcgattgattccgtcaagcttctcaacgaagcccgcatgaatacgtttgtgcttatctctttcatcataatcaaaggagtccatgagagactcttcgtgcttaaaatgcattttcacataatctgaaagcccatcgatgacgtcatcgacggccttattttcatactccgcacttgaagttgccccgagtattttcaggaaatcgataattttgcggtgttgatcatcgatgtcgtcccggccagtggcaatcgccgtagaccaaccaatttcagccttcatatcgaccgaagatgaaggggctattgcctctcggggcttacctcgcggcttgacctgccgctgatctgcggaaggagcaatcacaggggagccttcttgacggcgggtcagggtatcatccgcccgtctaaacggccctttgtagcccttcataatcgccgagcgtctgtccggcccatggaaggccggagaagaaataaaagccttctgcgtagtcattgcagccgtgatcgccatttgaagcgaatgtcgggttatgggtagggtgagcgaagcggatatgcccccgtctcttgccgcgattagctcatcggcggtccactggttatccagggcgattacgggaagggattgagggggttgcccttctccccagcggacatgcttcaaaacctttagatgcccagttccaccaagcttatcgcacaggatgatatttatgtttgatgcgtttccatgctcaaggagcagcatcgtgtgactaatgtcttttgtttcttcctgaacgacaaagccacactcacgcatcacagaaacaataagctttcttgtcgcggcattttcgatggcgacgagtgcattaacgtcaaatgaggacgaggctacgattgccatatgcggcgtccacctacgatttatcgggccgcttttttagaacatggaacaagaacttcgataaatctcttggattaaatggcttcttaaatgcccctgttgcaccaatagccatcgactttgccattagatcgttgtcatccgtagctgaaaatataataactggaatacaagaaatatattctttctgacttgctctaaccgcggcaacaacggaaaatccgtccactggctccatattcaggtccgttattatgatatccgggacaggatcactgaatgccaattgaagcccttcaattgcattggacgcctcaagcacgacggaagcccccatcacagataacaacttaaccaacaatgttctgcttgttgcatcgtcatcaattacgagtgccgccacatccgaacacggcaggcggaacaatttctgctcaccgtcaggttccaggcattcatttgaaggggctacccactcccgcaaatttgtatcaaactttttcacatgtccaataagccaagtctttagaaactcgtttaattccgaaatcgatcgctcattaagtggccgtgtttttgcgataaaatatgtcctggcaatgtcctgaacctgctccaacagggccttgtgctcatgaaaatgcatattgtggtagggatacatgcactcccgctgaatcttctcttccctggcaaaatgctcccggccataagaaagcaatgccttaagagtttcatgcatcaacttttcattgtttagcgacgccgagtggtcgttgaattcattaataatgtctataagacgttgatgatcagcatcaatgatggggtgcccgatgcgaaggtcgtcggttagctcaagcatccacatttcctttacttttaggtttcatgctcggcttccatcgccagatagaccagcgggcgattatcaacagcggaattatttatccaacgtttatatctctggtcttcatttgcaatgtggctgcgtagccagtgggcaaccaagggcggaaggtcatcggctgcggatgtaatgccttgctggaagacctctgaaatcgccttgatccgggcacggaattgattgtgcttgaggcgatgttcagcaaaattcgaataactgaccttacgcatagctttttcttcgcgaaggaaatgaccatcgacatactcttcaagaatcgccaatgagcttaatacgatcacgcctcggtcgccgccactcaaggtgtcgtgtagtaattttgcgagttcgaagaatgccttgtgatctgcatcaattgtttcatttccaacagacatttctggtgaaaattcaaaaattgaaatgttcgatttatttacggccatacccggttcattggcttgttcacttggcatagaaatacccattcacattgaaaaccaaaatcgcttaccgcccgccaattcgggcgataaagccatcaacctcgcggctaagattttcagactgccgtgacaattctgatgcagcatcagcaacctgaccagcggattcggtagcttcagcggcagtcgcttgaaccgtgatgatcgctgaggaaaccgaggacgttccggttgcagcttccgcgacattacgtgcgatttccacggtgaccgcattttgctcttccacggcaccggccacggcggacgatgtttcctcgatctgggatacggttcgagtgatttcctgaatcgccttgatagcttcggcggcgacttcctggatatgggccacctgggaggtgatgtcttcggttgccctggccgtttggttcgccaagtttttgacctcgttcgccaccacggcaaagcccttcccggcatcaccggcacgagccgcttcgatggtggcgttgagagccagaagattggtctgggcggcaatgtcattgatcaagctgacgatggcaccaattcgttgggcggcatcactgaggccatgaaccgtcgtatcggtacgagacgcgacaccggctgcttccgaggctacagcggcagcacgatggacctgggtactaatctccttgatggaggcagagaactcctcgacggcagaggccacagcctggacgttgaccgaggcttgttccgccgctgcggcaaccgtcatggcttggtggctggtgtcggtagactgtgccgacatggcccccgaagatgcttccaattctgtcgctgcggcagccacggcgttcacgaccggctttacctgattgttggcaaaggcgatgaactctgcgtctctggcttccattcgcttcaaagcttgattgatggtcttggcgtacagaacgaaatcgccacgcaaacccgtggtgatgatccggcggtaatatcgaccatgattggcggactcgacggcggcaaacgcctcttttccaaaggcttcagcgaggtccagcaaacggttgatgctgtgttgcaaggctccaatgccaccgctgcctcgaacgtccagaatccgagcgttgagatcaccactggcggaccggctgagcacgtggatcgcagtggacagatcacctgccattcgtcgagcagaaccaccgatcttgacgcctccgacaacgccaagcagggataccgcaatcacgacccaaagggcgatgctcgaaccaccaagcagcccgaatgttcccgccagtaagcagatcgccgaaggaaccagcatcccaagggataaggttcgggcatatgagccgagggtcgtttccatgtggctgcctctgatcaattttctggcgtgatggtgaagatgaaacggtcatagctatcgaatcccgccgttgctacggcgtcgttcagcattttccatgatcgctcaagcccgaccttcgaatctggatggcggcgttcttcttccatcagcgaacagtaaagcggcttgatcgtctccaatgcggccttctcgggcacccgtcgattggagtgatatccgatgatctgaccggcagcgtcgaagttcggggtgacatgggcgaatacccagtagttgtcaccattcttcgccatgttgttcacataggcgaatatctcccgaccatcggctatggtgtcccaaagcagtttgaagacgcatcgtggcatttcggggtgccgtatgaccgaatgtggtttccccatcacctcggattcggcatagccgctgactgtcaaaaacacgtcgttgacgtaggtcagccttcctttgggatcggtcttactgacgatcagttcgtcatgagcaaaagttcgctcacggcctgatggagttttacggtcacccgccatctccgacacctctcccagattgaatggattgtgaacacggcttcatgggcatactgaatggataaatgaatggtaaacgattgtcataaaggtatcgcatctgtttgtgaattgcgatagggttctgatcggcgacaagccgtagacattgtgaaattgggggcacaatgagccgagaaagtggacacgatcagttcgcggttttcgatgaaattcgagacgaatttttcgatgacgcaatggagcggctccgtgcccttgaattcgttctggataacggcagccatggccgaatcaaccgttcggaactaattggaaactttcggcggctcgccctgtatctgcgtggacaggcggcaggattcggtttgaatgccctctgtacgattgcccacaagctcgacgaatatcttgcggacgcccctgaaacgctgcctccgcgaatctggatcgatcttgaaacctatatcgatgagttatctaaacaggttggtagtcgcggcacagaaatccagcccgatttctcccggctcccacaaaaacttgcttcaacactggatgaaatcgagatcagacgcatcgaagtgatgctggttgctccccatggggcacagtcgcatttcgttgaacgtgaacttcgccaatgtggctacagaacttcagtggtccccgataccgtcttggcgttgtcaatggtggttcagacgaaaccagacctcattatcatttcggcagtcatgccgggattggatggaattgatttcgcgataggcttgtcggccatgccctcaacccgcaacattgcagtcgccgtcattaccagcctggatcgggacgcagatgtattgacgctgttgccgaagaaggttcccgtcatttttaaaggcccgaacttcgcagacgacctgttcaaggctctcgatagcctgttcatgatttagtcgggtgatcgctgccaagcacctaacttggcggattctccagtcggccacagacatcacagaaatggcatttctcgtttatccattgccgaatgcctgttaacacaccgcgattcgtaccgcgttccagcaagtagccgtaacaggccatcatgttgggaaattccatctcatacaggatcggaattacggcctccctgatcgccatgggggcttcggctaaggtgtcgcacatctcggactccttccccgccttacacggggcaccgccatactaatggcgtaaaaaaacaatacctccgaatgagttcgggttaaataacaattaacgcagcaacgatcttttgcggtgcagcggcgagggacgtcacgataccggcttccggggcgaagcatatcgaagaccgtcgcacatttcccactttcagcgaacaaatgccgaattcagccaaattgggtggggcataatgtgccgtcgatttgcctcctcaagagttctcaatttcccacaaaatgtctggaaagaggcacaccccaccggttcgttttgccaagtacatcgccctatccgccttatcaatcaaatctatagactcagttgagtcatctggataaagagcaatgccgagactggcccccgattcagcgtgacatatagctttccgataccttcttgccggatactgaaagttcctccacatcagcgtaggtgattttgtccaccccacccttcaattccagacatctatcacggaaggtttcaacagaataggatttcgctccggagaattttcgaattttctccgccaactcatcagcaatattttcaagctttgttaagcttcgaaaagtgctttcatttgtagctaatccgtcacgcatgccagccgccaaagagttacattcaaaaattatggctccagcaagacttttcagccgataatttactataacttgaatggcttcattttttttggattcgtactgctccatcggaatgcctcgccctaacgcctcgaccggattagggactatgatttgtggggccgaggcacaaccaggacgactttcatttcggcgttcaggaccaatataatcttgggtgacgataaatggcatccgcctttctacatgaccaacaatctgatctcgtaattggcctgatgagaatggaataagaagcacggaatctgttcctgacgacatggcactacgaaccgccacttcatctcttgatgaaaggagaagaaccgtcaatacgaatggatcgctatttgtctgcaaagatctgatttggcgaatgaaatacgccgagtcattcccatcaagcacagcatccatgacaacaatctggaagccgccatttttgcatgattcatcaatggcaataaaattattcgactcctctatatttgtgattccaatttcatttagtgtaaaccgtattccagatcgaattgtgctgcttggctcgcaaattaatgccgttattttagagtaatctaatttaactttggcatgcacaatggcattaggaacggctactttttcaggctcttcattctcaagagcgtcgagagcaagatacgcaagcggcctctgatcaacgtcgtcatcagtcaacaatgacttgaacttcatgtcctcattcataatgtgacttgcaagccacttaaggacaagatcgtgcagcttctccgcaacggacaaacttccgccacgatatagcctgatcacctcattaatttttcgattgaaggcaaagtgctttgcacgatgatcgtcaaagtgttgaaaaccaattttagccatggccttttcttcacggagaaagtgccctgcgacatattcttcgagcatagccaaagcactttcgattacgaatttgctttctgctgcctcgaaaatgacgcccttgagtaaattggcaatttcaaagaatgccttgtgatcgctgtcaatcgcagcattcccgacagagaaagcgtctgaccatccagcgatctggcattcttctgtcattcagcaaaatctccatggactctatcgcttaccgcccgccaattcgggcgataaagccatcaacctcgcggctaagattttcagactgctgtgacaattcggattcggtatagccgctgaccgtcaaaaacacatcgtttacgtaggtcacccgtcatctccgacgcctcttccagattgaatggatggtgaacgcggcctgatgagcatactgaatgaataaatgaatgctaaccgattgctataaaggcatcccatccgtttatgaatttcgataaggatcgtgcggcgacgcagggggctcatctcggccatcgtgggcctcctgtctgtcgggtgatcgggaaaccagccctgtcagatgggagccttcgacgtcacatcacacaccgataccgccatagcggttccgttcaatccccacgatacatgccccacccgtgcgggcaaggggcacggaggtggcttgaccggggggggggggggggggactcagggatacgggggctgcttgctgcgaacgctgtagcagataacgtcgatgccttcgccatgggtgtcgttggcggctttccatttccgggcgacacgctcgaaggtgaagaggtcgcgctgggtcaggggattggaatacagctcttccaagaccagaacctcgcccacgacccccaccggcatcagacgagccgacggcgaaatggaattggcgatcaactcgtcgctctcgcttccttcggaatcgacccggacggttgccatgctccaattgatcgccacataggactcgacctgcatgtcgcgcagcatgctgatgtacaggccgccgcagcgcagggcgttggtggggtcgccgaaaccgaccagaatggcgttgccgctggtggtcatggggacgctgacatcttgtccgaggaaattgcggttatactggaccagtagatccagcagcatggccttctcggccttggtcttccggctcacctgatcgagatacagggcgagaatggccaattccttggtttcgtaggtatagaaggggctgtcttgcggttcctcgtcaacggcgtcatcgaccggaacaggtaaacgcgagagggcctcgtcctgcacggaatcggccaaaagatctgaaatttgcgattcggcaagcgggatcggagcggctgtcgccatggggggcgcgtcgaaggcagaatcgtcgtcttccgccatctcctcgacggcggccagttccggctcgggctcgggttcgggctcgagttccggctcaatatccgcaggtacatccaccagcgtgtcgatgggttccggctcggattcttgctccggctcggccaattccggctgggccgaattgtcccattccggttgggtctcgaagaccggttcgatctcgttcgaaggcgcctcgaccgaaacggggggggcttcgaatccctcggcctcgaaggtctcgaccgaaacgggctgcgggcgttcggaaacggtgcggggcagaggctgttcgggctcgggctccagatccgcgacgatggtctgggggcggcctgcggtccggcgaatgaccgcgccggacatgttggcgccgtcgaggagggcgccggcggtcacggcatcggtcagatccgcgccggtgaaattggcattgcgggcgtcggcgcccgccagattggcgccggccaaggtggcgccggagaaattggcccccatcagcttggcgccggccagattggcgccggtcagatcgactccggacaaatccatcttgccagccagattggcgccagccagattggccatgcgcatattggcgccggagaagttggcgcgcagcaaggtcgcgccggccagattggcgccctgaagcttggcgcccgacagatcggcgtcttccaggcaggcccgggggaggttgcaatcacggagattcgcgccggacagaacggccttgcgcagatttgccagcgacaacagcgatccggacaaatccatcccggcgagattggccccacgcagattggcgttggtcaggtccggtcgtacatcgggctcctgctggcgccaggcgttccagtcgccggctccctggccgagatgttgtaggtggtgtacgtttcccatcacaagcaatcgatctgtcttttcaaacactcaaatcatacaccagaccatggatttttcaaaacttatctccggtcaggcggtgtgatgaaatgagcgggatgggtctgctgcaataacggttaactttgctttaataattgccaagttcttgtcttctttttccggtcattgacgaggaaccaggttgtggtggattgcctctattccggtgcgtggcccgtgagggagctgtacggttgctaccggctgcggcctttccccattgcccgttcccattccgcgatcacgctttcgtcaattgtctggggcgagtgttcctggcccgtatccgcgccggtggccgttctcaattgcgcttccaactcggcgatgcgcgcttccagcatggcgatcttctgggcctgggtcgggcggtctttatgccgctgccgatagcgtctttgcttttccgccggtgtcagggccatgtcgtctccgatgacgtggggcgggctcggcgtcgggcgcggccctccggccgcttggccgctcgctcaatgctcacccgagcgtcgcgcctcacatttgaggcacggcgctctaaagcatcggctcccatgcggcccgaccgatgccttgcctgatttgcgcctatgccttacctgatttacgattgagcagttggttcaagacgtcggcctgagagcttgcccgaacctcagccttgggggcgatggcggctttttcggcgggttcggtcgccgcggcattctcggcaggggcgggagaatgggcggatgcgggaggggaagggggagatgcgacgggcggtgggggggcggtgatctcgtcgtcttcttgccccatctcgctcgccatcttggcgatatcggttgcggcgccgacgatgcccctgatgatcgccagggcttcttccttattgacgctgtcgctcattttccccagctccgacaaaaacggccgtccggttgcggcggttggctaatctttcctaggtccgtccggggcggaagtcccacgcttcagatcggtggagtggcaacggaaaaggcgggtttggaatgggtcagcgagtttacggcggatatgtatcctccgacgcaggcggcgccgagcacgccgaccacgaccaatcccaggcccggcgcgatcgttaatgtgatcggcagtcccaggagtgctccggagagcagtttcggtgccgctaatttcagtccggccaggggggtgtcaaacataaaatcttccatgcagggctgtgtggatcgacggatctgagtccctccagattagcataggtgcagcctaaagcatcaagattttggggggaaaggccatccctcgtcccatggggctctccgatttttcgcgtgatccgcctgcggggagggcgggtggctttttatgcggttgcgtctcaaccgcttgtattggcggccaggcgaggcgatttattctgctttatcgtctgcgtggcgtgctctcgcctatatctggctggagtaattgtgctaaaaagcgcgggccgacagcggcgacgaatgccgtggaccttggtcgcgtcggccgcgtgattttgttgagtggtgctggatgacgatgcttgatggcgacgcgaacaccggggggcgccccaaagcccctcgcagcaaggatttgaagcgctacctcatgctgatgggcgtggtggccttgatcgtgctgttcggcgccttcatttttcgccagcaggcgggcggcaaccgccttggaaccctgatccggcaattgggtcacggcgccgtcaccgctccggtgcttccccttcctgcgaacgcacttgcgggggctccggcggcgacgggagtttcggccctgccgccggtcatggaggccggggctgcccaggtgggcggcggcgggggattttcccgcgtcgtctcccttttgcgtcatagcgtcgtgagcgtgaccgcatcgtcgtcgggccgcgccgccgcacccaagaccctgatgccgcccggtccctacgtcttgccgcgtttcgccaatccgaccaccaccacggtggaaaatatcggcaccggggtgatcgttcgcgacgacggtttgatcgtcaccaattttcatgtggtgcgcggcgccaattcggttctcgtctcggtgtcggacaacgggggggcgacccgctattcggctgagatcgtcaagatggacgaggcgctcgacctcgccttgctgaagattgctcccagggcgccgctgacctcggcggtcctgggcgacagcagcgcggtgctggtcgccgacgaagtgatcgccatcgggactcccttcggtctggacatgtccgtcagccgcggcatcatttccgccaagggcaagtccatggtgatcgagggcgtcacccattccaagctgctgcagaccgatgccgccatcaatcagggcaattccggcgggccgctggtgattgccgacggcacggtgatcggcatcaataccgccatctacacccccagcggtgctttcgccggaatcggtttcgccgtgcccagcaatcaggtccgccggttcgtggaagatgaagtgaacggcctgcccgccgccgccgccgcgggccccgccatgggagccgtcgcgtttcgggctccggggtcgggcggcgtgggggcggccggtccggccatcgcggcgggggtgccttcgccccataccgatggtcgacaggccatggcttgcgacaactgccatcagatcatcggtgccgcggcggggcccatcgccttcgctcagcccatgatgcccgtcgccgcgccgccgcccgccgcgccgcccatccaggccaatgccgccaatccccatgccgacaaccgccggaacatgaattgcgccggttgccatcagatcatcggtgccggtgccgggccggtcgccttcgctcagccgggggcgggcggatatcagttcgcccagccgcccggcggtctggcggtcaatgtccaaggcgcgcgcggcggaatcgggtccagaatggccggtcacagcctgcacggcgccgccttggcgcccctgtctccgcagatgagcctgcagaccggtctgccggtcgggcgcggcgtgctgatcaccggcgtttcccccaacacggcggcggcaaacgccggattgcggccgggcgatgttctgctcaagatcgacggccgccccgtcgccctcccccatgaggcggtcgccatcatgggggaaatgtcggtcggcgggtccgtccgtctgggagtcttgcgcgatggaggcgtccgcaacatgactttgattgccggggccgccgcgggaacgccgccgcccggcaacgggccgtggtgaaaggtaaagaattccgggttgttctgtgatgatggagcacgagatggcgacgaaccgacggccccgcgccaagaggacccccggcgacaagctcgggaagggaggcggcgatgccgcgctcgccccggctgccgacgccgagattccggcatcttccgcgccggagcccgccgcccccatatctgcgcctccggctccggtgatcaagccggtgggaggggatgcctgggcgtcgctgctgagcggttcgccctggtcttcccccggagcggcaagcccgacggaggcggcgctcaagccggtcatgccgagcgcattggcggaggcggttgccaatgcgccgcctgaagccgccccgttcaccgagcttgtctcccactggtcgcctcctttccggcggcagccggatcgggagtatgaagagatcaatcccgccgaggcggcaatcccggtgacggccgcggcgcccgagcccgagcccgagccggtccccgaacccgaacctgaacccgagccggaagcggctcacgatcatgccgcgaccgagaccgagggagttaccgaaatgatgacgagtgatgttgagcttgagattgagattgcttcggatgtggaggtcgtcgaggcccccgccgtgatcgagccgtctccccggccgcaggcattttcccactcgacggcctatgcctatccggcggaaccggccccggcggtggagacggcggcagaggccgcccctgccggccctgccgaaaatccggtcaaggaggttcccgtggaggacctgttcaccgggatcttcaatgtggcggattcggccgtgcgcggcgccatcggcgcctccaccgatctgctgagggatcccaagtccctgggcggtaagctttccgtcgcggggcagagtctggtccattccatcaagggacgcttcaatgctttgctggctccgcgccacggcgccaaaagcaacggtgatgaattctagtggttctcgcgggatgggcgatagaggacaggaatccgaatgagcttggaactcagccatgattgaagtcggcgagaccatgggcgaattgcccaccaacaagatcgtgttttgcgaacggtcatggaagacgcctgtctcgatcctggccttcttgatcttcgtgaccttcgcttgggggatctatctcctggaccattacgacgaggacgacaatttccatggggccgacgatctgtcggtgggtcagttcctggtgcgcaacatcgccatgccgcatgtgcagcggctgtatcacacggttccccctgctgtggtcggggtcggcggcggcggggtcaatgccggtccggtggcctcgggggccatcgtgggggccaacggctatgtgatcaccaccttgcattcggtgtccaatctgccggagatttcggtccaggtggcgacgacgggtgggatccggcgctttccggcccaggtggtgaagaccattccggggcatgatctggcgctgctgaagatgcagaccaccgagaagttcctgcatttccgcatggccgacgtccagacggtggtgccgggtcagcaggtcttcgccttcggccgcaacatggcgggggcgccgctggtgcgccagggcctggtgcaatcggcggatgcgccgctggcggtgggggcgacccagatcacccatctgctgcgttcggacgcggtctacagctgggaacagaccggcggcccgctggtcaacgcccagggtgatctggtgggcatcaacatcgccgctaccggccccgccggcaaggtggaaggcttcacggtgccggcccaggtgatcgtgtcccatcttcaggacgtggttcgcttcaagaagggcgctccggccggaaagtcgggcgttcccgccggtccttagacgtatgtggggcgtttccttcatacgacgagcttagagaggcggatatggcattaggcgacgcgaatgttggttcggcccctggggtcgacttcagtgcgctgcaacgggtgaagcagtcggaggagctgcttgcccagttgtacgtggtggaggagacgccgcgtcgtttggggcgtgggccggtgcacgctcttatggtcatatcggttttgtcggttgttgcgttcatcgcgacgttgctgatgcgctacaacaccttcgtgaccatgtcggaagacacgcaggcgaagcggtccaattacgaggtgatgatccagcgccgggacaatctgttcggcaatcttgtgaagctgacgctgaaccatgctgcattggagcactcgatcttctcgcatacctcggacaagcggaccgagggcgttgaggctggcaagggcggccctatcggctcggcgctggaacagctgatgaagcagggcgggatcggcaagcttctgggtgatattgggggcggcaaggcgctgctgggggccgacggaggcttcggcaatgcgctgggccgtttgatggcggtggtggagcagtatccgaccatccagtcggtggacacctacaagcatatgatgacgtcgctggtggagatggaagaccgcatcgcgacgcgtcgggaggattacaacgccgccgcctcgacctacaacatcgagatcaccaagtggccgtggaactatctggcgttcatcaccgggttcaagcgggcggagtatttccaggaaaagccggcgggcgacacgccgatcatcacgccgcagctgttccaggaactgttgcctctcaaccatgcgcaggacatcaagaaatgatctggacggcggtgatcaaggggagcgcgctggtgaccttcgtgcagggcgccatggtgctggtggacaagatcttcggcgaggagatcttgccgcaccggatctacagcagcgcggaagcctcgcaattgctggggatggaccgtctcgaggtgctgggcctgattcgttcggggacgatcaaggcgaagaaggtgggcgataattatcgtatcctgggctccaatcttgtggattacatgaaccgatgaagttcgaaaattgcagggattgccgcgaggaagtggtgtggtgggcctttaccgccgacatctgcatgaccctgttcaagggggtcctcgggctgatgagcggcagcgtggcgctggtggcggattcgttgcattcgggggcggacgtggtggccagcggggtgacccagctcagcttgaagatttcgaacaagccggcggatgagcgctatccgttcggctacggcaacatccaatacatctcgtcgtccatcgtgggctccttgctgctgatcggggccagcttcttgatgtacggctcggtgatgaagctgatctcggggacctacgaggcgccaagcatcttcgcggcggttggggcgtcggtgacggtgatcgtcaacgagctgatgtatcgctaccagatctgcgtgggcaacgaaaacaacagcccggccatcatcgccaatgcctgggacaaccggtccgacgccatctcgtcggcggcggtgatggtcggcgtgatcgcctcggtgatcggctttcccatcgccgacaccatcgcggccatcggcgtctcggccctggtgggacgcatcggcctggaactgatcggaacctcgatccacggcctgatggacagctcggtggatacggaattgctgcagaccgcctggcaggtggccatggacacgcccatggtccacagcatctatttcctgcgcggtcgccatgtgggcgaggacgtgcagttcgacatccgcctgcgggtcgatcccaatctgcgcatcaaggacagttccatggtggccgaggcggtacgccggcgcatccaggaggaaatcccccacgcccgcgacatccgcctgttcgtcagcccggcacccgccgccgcggcacgggcctgagcgagagaggggccgcccgcgccatgggcggcgggcagtttagttccatcggaaggggttcagacccgacggtgacgggcggcggcggatccgtagatcagaccggccatcaagccgacggcgacggcggcgcccagcggaccgccggctagggcgcccaagccgacaccggccatcttgcccatggtcaggaagcccgcggccttggcggttcccgccgccacggcgccaccggcaccggcgacggtggaacgaacgaccgtgcgggacccggcggaaggagagaaggtggcggcttgacggctcatggggcatctcctcggctgtgattgcgaacaaatcgcatctacagaaagccgcaattgccactcattgtcaatgggtattcgcatcgcccccgatgagccgcgcggattgccgtgccgcttgaggggggggcgcccgcctcagtcggcggtttcgtcggcggccagcggaactccgaacagctccaggcggtggcccacgacccggtagccgtagcgcgtggcgatttccttttgcagggattcgatctcctcgctggagaattcgatgaccttgccggttttcaggtcgatcaggtgatcgtggtgatcaccgtcagcttcttcgtagcgggcgcggccgtcgccgaaatcgtgccgcttcaagatggccgtttcctcgaacagccgcacggtgcgatagaccgtggcgatgctgatatggggatcgatctcggccgcccggcggtagacttcctccacatccggatggtcggaggactcggacaggacgcgggcgatgacccggcgctggccggtcatcttcatgttcttgtcgatgcaacgttgttcgattcgagaaatcatggccgtctcatccgatttttcctgccggttcagggggaacggtaccatcaagggagaggttggcaaagcgcgagagcgcaaccgcgcgtttcgctgccgtcgcggtcatatagcgtcctgctgtgcggagccgggggcggtcagtgagccgatgatctggcattgggcgaccacctgtccgcagcaattcttcatcttccgcaattcgtcgcgcaaaagggtgaggtcggcaattttgcgttccacctcgtcaagatggaggagaaccatctgatcggcaccttcgcacggggaatcgggtcgttcggccagagtcagcagggcacggatggaatcgatggaaaagcccagatcgcggccccggcgaatgaagcggagccgctgaagatggtggtcctcatattgacgaaagccgccctggctccgtgccggcggcggcagtagcccgatcttctcgtaatagcggatggtttcgatgttgacgccggtctgccggctgaggccgccgatattgaagggctgaagcgtcatgattttccgttgactctgtagtggctccagggtccatgctccacttgaatcgggtgattgtccagcgcgatcacggaccgcgtcgaaggagttcgggtcatgtcggaagccaaatcttgctgcaccagcaaatgttgcggcgggggcgcgtcagcggttcttcccactgcggcgctccagccgcctcggccgggtaagtcccgggccttccgcatcaccggcatgtgctgcgtcgaggaggtgcggacgctgaaggcggccgtcggcccgctggccgggggggacgagcgcctgagcttcgatctgctcaacggcaagatgatcgtccgggccgatatcgacgccgacgcggtgatcgccgccgtttcgcgcacgggaatgggggcggagccgtgggaacgcaccagcgtggccgagcgcgacaaggccaattcctcgcgccggttgcttcaggcggttctggcggggctcagcggcggcgccgcgctgctggggctgattctcgaccaggcggtcaaagtgccgctccccgcccagatcgccgaggccgtggccgtggcggtgggtttgtggatggtgctgcccaaggcactgcatgccgttcgctcgctgcggccggacatgaatttgttgatgagcgtcgcggtcttcggtgccatggcactgggggactggatggaggcggctaccgtttcggcgctgttcgcgctgtccctggcgctggagagctggagcgccgagcgcgcccgccgggctatcgcctcgctgatggacctcaccccgcccatggcgcgggtaaagggaaccgacggagccgaatccctggcggcgccagaggatgtacccgtgggggccgtcttcgtcgtgctgccgggtgaacgcattcccctggacggccgcgtcctggtgggcgaaagcatggtggatcaggcgccgatcaccggggaaagcgtgccggtgctgaaaagcgtgggcacggaggttttcgcgggcaccatcaatgccgacggcgtcttggaggtgcaaaaccttaagccggccggtgaaactaccctggccaaggtggcccggctggtggaggaggcccagggcaagcgatccaaggtggagcgctgggtcgatcgcttcgccgcgatctatacccccgtcgtcctggccggtgccgtggcggtggcggtgctgccgccgctggcgctcggcctggactggtccgaatggatctaccgctcgttggtgttgctggtcatttcatgcccctgcgccctggtgatctcgacgccgctgacggtggtggccgccatggcctcggcggcgcgggccggtgtgctggtcaagggcggggaatatcttgaaacggcgtcgcggctgtccgccatcgccttcgacaagacgggaaccgtgacttcgggccgccccggtgtcgaacgggtgatggcgctggacggcggcgacgagggccgcatcttgcggcttgcggcggcgctggaggcgcgcagcacccacccgctgggccgggccatcctcgatcacgccgccgccgggggcattgctccgactccggccgaatccgtccagtccctgcccggcaaggggatgtgcggggtcgtcgatggcgaggcggtgtggctgggctcccatcgttacgcgatggagcggggtgccgagacgcctgccgtgcgcgaggcggccctggccttggcggaaggggggcggtcggtggtggcggtgggggatgccgccggggtacgcgggctgatcgccctgtccgatcccattcgtccggaagctgcgacggcgctggcgggcctgcgccgggccggggtgggcaaactgatcatgctgaccggagacaacgccgccaccggcgagcgggtagccgctgccctgggcttcgatctcgtcctggcggaactgctgcccgaggacaaaagcgaggccatggacgatctcgcccggcaattcggaaccgtcgccatggtgggagacggagtcaacgacgcccccgccatggcccggtcgtccctgggtatcgccatgggggccgccggaaccgataccgccatcgaaacctcggatctggcgctgatgtccgacgatctgaccaggttggcctggctgatcggccattcccgccggatgatgacggtcatccgccagaatatcggtttcgccatcaccctgaaggcggtgttcatggtgctggcgattttggacatcgcgaccctgtggggagccatcgcggcggatatgggagcggcccttctggtggccttcaatggattgcgcttgctgaaggccggcgttactcagaggtccgaggacggcatgggcttatcctcgtcgtcgaataccttgaaacagaggcttgcctagggatggaggggcgatcatgcatgttcacaatctgtcgtcatggcaacacagccaccatttccaatcgggcctggaagcatccgccgaacgtcggaccaagatcgtggtggctctgaccatcgtcatgatggtggccgagatcgcggcgggcacgatcttcaactccatggcactgctggccgacggctggcatatgtccacccatgccggggccttgggaatcgccgccttcgcctataccttcgcccgcagtcacgccgacgaccagcgctttaccttcggcaccggcaaggtcgggacgctgggcggctttaccagcgccattatcctttgcatggtggcgctgctgatggtgtgggaatcggcaaaccgcctgatgacggtccaagccatcgccttcgacgaggccctgatggtcgccgtcatcgggttggtcgtcaacgtggtcagcgccgggattttgggcggacacggcctcggcgacgaccatgatcactgcggccaccaccacgatcacgaccatcatcgcgaccatcacgaccacaatctccaggccgcctatatccatgtcctggcagacgtcctcacctcggtgttggccatcgccgccctgctgctggggaaatatctggggtggtggtggatggatcccatgatgggattggtcggggccgccgtcatcggcaaatgggcctggggcttgatgcgcaagaccggttcggtcttgctggatcacagcgacgaccgggagctgccggaggaagtccgcgccgccatcgagggcgatgccgacaaccggctgtccgatcttcatctctggcagatcgggccgggccattggggggccatcgtctcgctggtgacccacaccccgcgcgagccgggccattacaagacgctgctggccgaggttcacgaactcagccatgtcacggtggaggtccatccctgcgacggggcgtcttgcggctaaagcggtttgcgctttatctggcgcaaaccgctttggcgagcattgagcgagcggccaagcaaaccgtaggtttgggcccggcgagggcatacataagattatagccttttgcgtcacattcgacgcaaaaggctttaggggggcttcccgatcggctcatggcaatcggccttcatccggcttgccgcgggggcgggcggtgctgtggtccggctataatttccgggaaaaaggggatgaaatcaggatgtgggccattccgacataccttctggccgctttcgccgagatcggcggttgcttcgcgttctgggcctggctccggctgggcaaatcgcccttctggctggctccggggatggccagtctggccctgttcgcctgggccttgacccgggtcgatgccgatttcgccggtcgcgcctatgcggcctatggcggcatctacattttgtcgtcgttggtgtggatgtgggcggtggaagagagcccgccggaccggtgggacgttctgggcgccgccttctgcctggcgggcgccctggtgatcattttcgccccccgcggcgagtgatgccgtaatcggccgcagggcggcggggcgtttcgtcaggcgattccggtggctaccaccgaaacccgcatcttgccggccagggcgtcgtcgaaggtggatccgaaaatgatgttggcctcggcggccacttcctcgcggatgcggttagcggccgagtccacctcgaacaaggtcatgtccatgccgccggtgatgttgatcaggacgcccttggccccctttatggaggtgtcgcccagcagcgggttggagatggcggcctcggcggcgtcgatcgcgcgcttttcgccggcggcctcgccggtgcccatgatggccttgcccatttcgctcatgacgatgcggatatcggcgaaatccaggttgatcaggccgggcatcaccaccagatcggtgacgctgcgcaccccggaattgagcacgccgtcggccatcttgaaggcgtcggcgaaggtggtgcgctcggtggcgacgcggaacaggttctgattggggatgatgatcagggtatcgagctcttcttgcagggcttcaatgccgagatcggcggtgtgcatgcggtgcttgccttcgaagtggaacggcttggtcaccacgccgatggtaaggatcccctgttcgcgggcggccctggcgatgaccggtgccgcgcccgacccggtgccgccgcccatgccggcggtgatgaacaccatatgggcgtcgccgatcaggtcttggatgtcttcgagactttcttccgcggcggcgcggcccacgtccgggcgcgaaccggcgcccaatccctgggtgacccggccgccgagttggatgcgtcgctcggtcaggctcagccccagcgcctgggcgtccgtattggcgatgatgaattccacgccctcgatcttggactggatcatgttgttgacggcgttgccgccggctccgccgacgccgatcaccactattctcggacggactatcgtcatcgcaccatcaccgccgataagacatgcgccgcgtgtccagcctcatcagccgatccgcagggcgcgcagcacgttcccgccccgccactggtgaaagcgataccacagcaaaacgatgacggccgccgcatagacatagggttcgccgttttcgtgattggcggcaaggatgaagtggagcgccaccagggcgttgatcacataagtagcactgtgcagtttcttccagcgcttgccgccgatccgcttgatctggctgttggccgaggtgaaggccagtggaatcagcagcgcgaacgccaccagaccgagcaagatgaacggccgcttgtagatgtcgcccatcatgtcgcccagattgagcgcccattccaaggcgacataggccaagacgtgcatcaccgcgtagaaaaaggcgaacagcccgatcatgcgccggtatttggccagggtcttgatgccggtgatttcctggaccggacgcatggccagggaaataatcaagaaggtgaaggcccaatcgccgagatagcggttgacgaagccgacgggggcctcgcccagggacccgttggagatatagccctcgatgacgctgcgtcccaccagccagacgaagggcagtgcggcggtcaggaataccagcggcttccaatccactgtgcgggccgatttcagatgatggtcgcaggtttcgtcgatgccgttggccagcagccaggcggcgtaaagggtcaccagcatcttgcccgttcccatcaagatgaacggggcgcgggggccgagggcgtcgaaataatagccgccgctttggaccagcatgacggttcccaggccgccgaccagataaccggctcccaccatggcccccaggatcggcttgggcgaggcgtccacggtcagaacctgaagggtcacgaaacatcccgcatggccgattcccaccatcagcagcggcagcgccaccagccagttgaagggattggcgaacatgcccagccagatatagcccagcgccgccagggacaggctggcgccgatggcggaaatgcggctgtgccgttcgatgaagctgcgccatagcggcaccgccgccagcaccgccagccccagcaggccgatcatcacggcggcatgggcggtggcgaaggtgcgggtcacccccaccagatcggaaacggaaatgcaccacagcgagaagaacaggctgaggatgatcacgtcggcgcgggtgtagaaggcggcggcgaaggccagctgcatgcgcggatcgctggtgatcaccgtccagacctgccgcagcggatgttcgtcgtcttccgaggccggctggggcggggccacgtcccgcagattgcgccgcgtcagctggaaaccggcgattccggccagcagcggcaggcacatgatgaggaagacgccgccgggataatcggccatctgcatgacgatggcggccagcatggtgccgccgaacaccatcatgaagaccagattccccatgaggcgcggccggttggcgcgcgacgacacatcgcccaccagggtggacagctgcaactggacggtatcggcgcccacggtcagcagcacccgggtcagatagaacagcaccagaccggcggcgccgaaggccagtcctacctgaaggctgagcagcgataccgccgcgccgaccacggcgatcaggaagcccagggcgatgatccgcacccggccgatgcgatcggacagcaggccgaaccagcccacacagacgatggagacgatttccgccaccacctggatatcggcgttgacggcgccttccttttcgaaggcgatgccgaagatcttgtccagcagcaggggctggatggaaatggaaagcgccgccatcagggcgcccacggtcatcagcagatagatgatgttccattgggtgggggcgaagtcgtccgccgtcgtccccttggccggagcctcagcgttcctcggcatccatgcctcccgcattcgcccaaaggccgttgaggtgattgtcgcgcaaggcgcagatttcgccgttggccatgacgctcatggcgtaatccagtcctgcggcggcttgggtcggatcgcggaaggcggtgcccttgacgaacatgccgggacgaaccacgcagccctcggcctgcagataccagcgcggggccaggtcgatccagatgggcggattgatgccgtcgttgatctggatgtagatgtcgccccagactgagcgggctccggctccggcgatgctcacgaccttgccctgatagcggaagggcaccatccgttcgtgggcttcattgcccagggggacggcggcgggggccggagccaccgccagggccacgctcaccgcctcgggcaggggcatgcccggtgtgaccgccgccggaagcggcgccgccttggcgcccttggcgacgctgcctttcttcacgatggtgtggcagctggcgcagggcattttttcgcggccgtccacatggggcgccggggttccctggacgatgggcagggttcccgatcccggtccggtgccgatggccgggggggtgacgatgtggcagctggagcagaccatcttctcgcggccgtcgcgatggggggcgggcattccggcgacgatgggcggggccagatcgtaggtgtggtcctcccagggattggcgttgaacacggcggtcaggaccagggccatgctgaaggcaatgcccagcgccatgatccaaaccgcgatattgggatgtgcaacggccttactgctcacggggactcgatcgatggcaaagtgtttaaccggtttgtgctttggcgtcgggggtggccgcttataagaacggctccaaactgtcgaggcggaagtttctcatatcccggttcggaatggaatgaccatagcccatcagtccatgccggaatcgggcgcggtttccgtccagacggggcttccgtcgatcaggaagtgttcggctagggctttttccaaggcccacaactcgccgtcctcgaagacgatacggacgaggtcgttgggatcgcaggcggccaccagggagcggatctcgcgggcttcgcgcaagattttggaaatctgctggcggacgctttcggtgtcctcggcgcaacggcgcagctgttccgagcggttgactgcttcttggaccaagctgcggaaaaagacgttcttgtcgccggcgaaataggcggtggtcagggtcgagatgaatttccgcgttccgtcccggtcgccatgggcggcgttcagatgttcggtcagcacctgggtggcggtcatggacagatcgttgagggccagccccagaacctcggccaaggcccgcatgcggtcgatccgctgcgacgggtcgaggccggggggcgccggcgcgacggtgcggctttgggtgatctgggacaattcctgggtgatctcttgcgacagcacccgctgggagcgcagctcatcgacgatgccgtcgcggctgtcgcgggtcacctggaccagctgggcggtggccgatgcctgggcctccaactgggcggccaccgcctcgcgatgctcgcggaacagctgggccagcaaggtcatggcctcgtcggtgccggatgcctgcgcgggcgcggcaagggcgcggccctcctggttcagccggatcagctgggtggtcgcttccacctgggcctccacctgggcggcgatggcggcgcgatgctcgcggaacaggtcggccagcatggccacggagccctccgacgacacatcgttccgggacagggttgtcacctcggatttcaaggtgtccacgcttttcacgatccgcgagagcatgagaatcaggacggtcagtccgatcggcaaggcgatggacagcagcacgatgaagaattcatggggaagcatggtgaagagatttttccaaccattgaaaatggtcagatagacgatggacaggacagcccaaatgaccgcgccgatcaaggccgcgcgggaggcggaattcaacttgccgaaggctgccttgttaaaccccatcaacataaggacatctcccatgatggccgcaatcgccatcccaatgcgccgccccgcaggcgttccccttatagtaacagcaaggcgaacggcgggataccttcgaaacaatccattgatatgggttgggcgtcgatgcgtcaatgactgaaattgcgtatgattatcataatcctatgcttcgtcaacacgatgctgcattgttgaacatggcggtgtacatggcggcggcattatgctatcgcccgaaatcagggtttgtccggtccttgatgggccagcgacggtgatcggcgggcaggaggcaagcatgagctattcccaggaaatcagcagggagtgcaagggagtcttcttgttcatggtcgatcagtcccgatccatgaacaagcccttcggtcccgatcggtcgggaaagatggtcagccgcgccgaggtggtggccaatgccttgaacggcaccttggaggaactggtcaaccgctgcatgcgcgatgaaggcgtgcgcgattatttcgacatcgggatcatcggctacggccgcaccaatcgcccggaattctgctggcgcggcggcttggcgggtcgtcggctggttcccattccggaagtggcggccaaggccgagatcgaggaagtggagatcgaaactgagatgcgcgggcaggtgctgatcgagcgcatcaccttgtcgcgctggatcgatccggtgggagtggacagcacccccatgaacgccgcgttcggtctggcccatgccaccttggcggaatgggtgcgcaacaatccggattcgttcccgccggtggtcatcaacattaccgacggcatggccaacgacgtcaattccgatgccgagcttctggccacggcgcgcaagctgaccgggctgacgaccggcgacggcaatgtcttgctcatcaactgccatatcgcgggcggcagcgatgcatcggtggtgttccccgcttcggcggcggaactgccccgcgacccctatgccaagctgctgttcgagatgtcgagcgaattgtccaatcgccatcgcgccgtcatctgcgaaatcttcgaccgtgaccccggccgcaccccttccatcaagggcatggctttcaacgccgatgccgtggcgttgctcaagctgctggatatcggcacccgtcaggccatcggcctgtcggtggccatggagcccttcacgccgccgggaattgaggccgcatccctgatcgaggattccttcgtgctggaagaaccgtccgtgcggatcgaatatggcgatcaaggctgatccgcccttgattcggcgcgctacccccatgctcacttggacggcccagggccgctcgatcgtcaagccccgcaacgacagctacgccgatggcgacaggctgcggtggcggcaaaacgaagaccggctgcggctggctcggattcccaacggcctgctggccgccgtctccgacggagccggaggggcggggctgttctgcggcccctgggccgaaacgctggtgagccgcctgcccaagacccccatcgccggggtgaatgcgctgaaccagtggatggacgggttctgcctgggctttcgctcggaatacgccgccttgtccaaggccactcccgcccggtacagcaagttcatccgggaaggctcgttcgccacgctggcggccggctggctcgtccatcgtcagggccgggtccggctgcgatggatgggctatggcgacagccagatgatggtgttcgaccgcaccgggcgccagcctgtcctggcgacctgttatcccgccagtttatcggcgctggatcgagcgcccttcttgctcaactggaaggatctgccacacgattccggattccatgccggggaaatggtattgccggatcgggcgacggtggtgctggcgtcggacgggatcggccagtatctgctgctgcggaccctggccggtcagccccgccccgcggcggcggcggggctggcgggagaattccagcggctgtccggcaccggcgagagcaagcttgccacggccgcccgtgcccatcgcgccacgccggggcccggcctgtccgccgagctgacggacctgcgcgattgcctcaaatccgatcaagccttcgccgatcgggtccgcgccctgtgcggcaaggggctgctggccaatgacgattgcacgttgatcatgatcgacgtcgatcttgcccggccccggtaattcgccatgccgcttcccctgatcaacgattacaaggcagccatcgccaacgccaaagggcgtttcgcgaccctggacgtccggccgcatctggatgcccgctgcagtccggtcttcctggcgggaaacttcgccggggtgttcaagatggtgaccccggagggggagcatgtggcggtcaaatgcttcacccgcgaagtctcggatctgccgcgccgctatgccgccgtggctaagttctgccggaccgcccaatgcccctatgtggtgcccctgcggtttcttccggcggaggtcttcgtgacctccagcgtcgccccccatgccgattacgcggtggtgaccatgccctgggtcgagggtcggggcctgggggccgtcgtccagatcctgtgtcagcgggaaaacgctcccgccctggccggattgacccgggcgtggagtcgtctgtgcctggatttgctgcaacggggcgtcgcccatggcgatctgaagcacgacaacgtcctggtcggacaggatggcgccctgaagctgatcgactatgattccatgtatctgccggagttgaaggggctggcctcgaccatgctggggggcgtcaatttccagcacccccggcgtgaggtccggcatttcgacgggaccatcgaccatttttccatgctggtgattttgctgtccctgcgggccttgaccttccagcccgatttgctgaagcgtcatcacaacggcgagaatctcgtcctgaccaaaagcgatttcacccggccggacagttcggatctgttgcggcaatgggcgctcagcccggacttccatgtccgcgactggacggaacatctgatcaaggctgccaaggctcctatgatcgggatcgccgccatggaagccctattgaaggcggcggcaaaagtcgaggccgttccggccaagccacccaccaaacgactcctctcatttttttcctgagggcgcggcagccattggatttgaccggatcgacgagggcctgccagtcataacctcggtcgccgacaaatgcctgagccgtcggtaagccctcaagcatggtcggggccgccgccttgtcggaggttttgctcggcgttagcagcaatttcaccggcaatccacgcacgtccacgatggtatgaattttggtgctccgtcctccacgagaacggctgatggcgatatccgtgccccctttttacccccagcggcatgctgttgggcggggcatgacctcccatatagagtcttgtcaggaggggggatctgcgctattgaagatgcgagccagtcgcactgcataattctgctgggttcccaatgaagaagatcgccagtttatcgaatgtattggctggagcccttgtccttccctccctcttccttgccgttttaccggccgctgcaaatgaagtcgctgctgaggtagaaaaggggttctgggatcgtgagaagctgaccgccacctgcaccgcagaaactcttggcaatccctcggacggcatcaatcggcgcgctctcggctggccagccatccatgccgccaacacgccatcgggcggtggtggctaccccctggctgacacgggcacccgcctgaaggtcaagcccaccgaagagatcagcctgacggccgctgtattctccggcaacgatgcccagaagcgcgatcgcagctgcacggatttctccttcgattctcccccggtatggttcggtgaggctgcctattccatcaaccaggacaaggactcgccaggcattcctgcgactttcaagctctaaccgctttcgtgccggccctggacagccagaaaatcatccagggccgcgatgccatatttcagaggagccgtcccgtggcgcagcagatgaattccgacactctcagccttgccgaccttcgtcccgagcagcagggtgagatcgtcaagatcgaaaccgaggacggcgttttcaagcgccgcatgcagtctcttggcgtagtggccggtactcccgtcaccctggatcgttcggccccgttaggtgatccgcggatctacagcctgatgggctacagcctgggcctgcgcaatgccgaggcccagcagatccgcatccgcgtcaaataatcaccccaccgacctcgatccaagggtagccgcacatgaaatcccccgtcaccgtggcactggtgggtaaccccaatgccggttccaccagcttgttcaatgccctgacgggcgcccaatccgccgtcgccaactatcagcgggtgacgacctctttgaatgtgcgcgagattacccatggcggggttcccttacgcatcgtcgatgtgccgggcattttttccacctcgtcgcaatcgccggaggagaaggtcggctgcgactatattcacggcgaggaacccgacatcatcgtcaacgtgctggatgccggccatctggaccgcagcctgttcctgaccacccagctgatcgagaccgggctgccccgcatcaccgtgctgaacatgatggacgaggtccggcgggccggtattcgcatcgacaccgccctattggcctcggccctcggatcgccggtggtggagacctgcgccctgaagaaggagggcatcgatgccctgctggacgcggtggcggccatggcctcgacaactcccgccgccgccccgctgcggctgcactatgacagccacctggaggcggccatcgagcgcgtccagcagcatctgtccaagctgcacccccaggagctgagcccggtgcgctcgcgctggctggcgatcaagatgctggaaggcgatgacgaggtgttgcgccacgaaagcaaccatgtcgaactggtcgaggagatcaagggcgagcaatcggccctggcccacgagcatgatgaagacaccgccagcctgttggcctcggcgcggttcgccttttccaacggcctgctgcgagaagtccgccagcaggatggcgatcccaccgccgggttcaagctgacccgtatcctcgacgatttcttcctgaaccgcactctgggccttcccttgctgctgggcatcctgtgggtcatgttcgaggctacgttcaccctgggcgccattcccaccgactggatcaaggccggggtgcaactggccaccgatctggtggacaagacgctgcccgagggcatgttccatgatctcgttgtcaacggcgtcatggccggcgttggcggaaccattgtgttcctgcccaatatcgtcatcctgttcttcttcatggccatcctcagcggcaccggctatctggcccgcgccagcttcctgatggaccgggtgatgcaccatttcggcctgcacggcaccaccctgatccccatggtggccgggttcggctgtaatgtccccgccgtcatggccacccgcgtcatcaccaacaagcgggcacggttgatcgccatgctgatcgcgccgttcatgaactgctcagcccgcctgccggttttcatcctgttcgccggagctttcttcgccgatatcgccgggaccgtggtcttcggcatctatatgctatccctcgccgccgccatgttgtcggcggttttgctcaatcgcatcattcccggcagcggtggcgacgccttcgtgatggagctaccgccctatcgtctgccgaccctgcattcggtgctgcaccatatgtgggacagcgctcagggcttcgtcgccaaggtcaccggcgttatcctggtgggctccatcgtgatctggttcctccaggaattcccccgcgacatcacctattcccaggatttcgagaccgtcatcgccgaacagaccgcgcttcccgacagcccggaaaaggaaacggcgctgaagacgctcaaaagcgctcaggcgcaggagaaactggaaaagagctatcttgggcgttcggccatcgcggtgacgccgctgttccagccgctgggcttttcctggcgggattcggcggccatcatgaccggctttgtcgccaaggaagtggtggtggcgacctatgccgtcatctatgcccaggagaaggggtcggaccagctgaccgagaccttgaggggcgccatgccgcccgccacggccatcgccttcatgatcttcaccttgctctacgcgccttgcctgtcgaccatcgccatcatcggcaaggaggcgcagagctggcggtgggccgggttctcggtggcctattccctgaccttcgcctggctgctggccctggccgccagccggatcggcgggacattcttgtaggtcttgttctggtggcggagcggctccgccacctcttgatgaaagaagcgttgcgccatggcttggggatcactctgggatataggcgccattattgtcgtgggagcgggggcggccttcgtggtcatccgtcatctgtggcggatgtggcggccgtccgacggagcgtcgtgtggcggtggatgcagttgcggcgccaagcgaaacggcgaccgcaccgattgtggctgacccccgccatggggatgcggcaatgatctctcgcgatcaactgcctcggaacggcaggctgaagataggcattctgctggggttggctgccgtggccatgggcattatcgaaattgtcgataacggccccgccttgctgcgcggcaccctcgattggtggcgccggatgtgaccagaaacgccccacaaaaacgccaacgccgagatgacaccatggagtcatctcggcgcggcggatccgttcagcagtctcagatacggtcggcgatatatccgaccagcggcagcttccaggcgcggcggaacgccaccgaggccagcccggccaccgacagcacgagaaccagcatggacgagaagccgaagaaccactttccgatgccgggaatttccaggacgaacatggaaaggaccgcgaccatccacagcaccagcccttgcttggcatggaactgaacgtattcgtcatccttgttgcgcatcaaaggcacaaaacaaagaatgccgagatagctgagggcagccatcaccaggggcttgtaactggttccggtttcttgcgacaacccgatagtctgtgcggtcatttcgtcctccttcagacggcttcggccgcagccggctcggcattgcggttcttgtaatatccgtagagagcgatggcacccgccaccccgaccacgcccagcagcaccggcccccaggcgcccagacccaggccgaggcccaagctgacgcccttggcggacagcatggcgctgctgctggttgcggcggcgatggggctggcagtgacggaagcacccgtggcggcacccgccgcggtaccggcagcaccggctccaccggcggcaaccaatgccttgcccttgacgccggtagcagcgaccttggtcgcgccaccgacagtgctaccaaccgtgccggctcccttagctgccatagcggcctgattggcaccaccagccgccgccttggttccagcggctttcatgcccgcagccttggcggtcaccgcctcgcgctcaacctctgccgcggctgccttggccgcaccggtcttggttgctgcgccattggcggcgccagctttggccccaccggccttcatgccagcggcctgagcggcaccctcacgttcgatttccggagcagccgcggcagccatggccgcgccgccagctgcgggagctgcggcgttcgcggcggtcccaccagccatacctgttgccatctgtgctgccataacctaactcctctgggaaagagataaatacatacatgtcttgttgcacaaattcgccggctcgacaatagtcggcaagcggataacaatgcctcaacagcaaaataagttaataatcactctcatatccgcgcttttgccgtcagcgcttcatgctgttttgtccaagaatttgatggagccatagtctttgcaaaagtgatggcgcgtgagattcagggcctccggttgttccatgatcaaggctccggatatgacctgatttcgccggcagagatcccctccagcgtaaatcctaccgtcgttcaaccacaggagacgtgatccgtggcctattcacaggaaatcagccgcgaccagcgcggcgcctttatctttctggtggatcaatccaaatccatgaacaccaccttcggtgtcgatgataacggccagacgatcagccgggcccaggtggtggcggatgcgctcaaccgaaccctcgacgagttgatcaaccgctgtatgcgtgatgaaggtgtccgggactatttcgacatcggcgtcatcggctatgggcgcactaaccgcgccgagttctgctggctgggagccttggcggggcgcagcttggtgcccatctccgaggtggcggaaaacgccgataccatcgaggaagaaaccaccatcatggttcgcggccagccggtggtcgaacgggtcgccgtttcgcgttgggtggcgccggtggcggtggaaagcaccccgatgaacggagcgctgcgcttggcgcaatcgatcctggaaccctggatttccgcgaatccagggtcattccccccggccgtcatcaacattactgacggcatggccaacgatgttgacagtgacgaagaacttctggcgaccgcccggcggctgaccgggctgaagaccaatgacggccacgtcctgctgatgaactgccatatttccggcggcgacgacgcgccggtggtgttcccgtccagcgccggccaactgcccgacgacacctatgcccgcctgctgttcgagatgtcgagcgagttgtcgggccgccatcgcgccatcatctgcgaactgttcgagcgcgacctgaagaccaccccgaccctgcgcggcatggcgttcaatgccgatgccgtcgcgctggtcaaactgctcgatatcggcacccggccggccatcgtttttaaccaagccgccgaggcttcgtcacacgctcggaccacggagttcgaacagtgacgttcccggtattggcggactacaaggcggcactctccaacgccaaggcccggttcgccactctacaggtgacaccgttcaaggatgcccgaggccacccgcagtttctcgccggaaacttcgccggggtattccgggtcaccgattccgagggatcgctcttggcgatcaagtgcttcatccgtgatcttcccgatctggagcgccgctacaaagcaatctccggcttcgtcgccgccagcggctcgccctatatggttccgcttcggttttaccgcgacgaactctacgtgacgtcgtccatcgccaagcacggtgaatatccggtcatcagcatgccttgggtccctggccgcaccatcggcgccttggtccagaccctgtgcgatagcgacaagcgcggcggcatcgcaggcctgagccgggcctgggcgcggctttgcctggatctgctgaaccgtggcgtcgcccatggcgaccttaaacacgacaacattctgatcggacctgatggtcggctgaagctgatcgattacgattcaatgtatcttcctgaactgagcgggctgccctgcaccttgctcggcagcatcaatttccagcaccccgaacgcaacgagacgcatttcgatgcgacgctggatcacttctccatgctggtgatgcaactgtcgttgcgggccttggtgttcgaacccggattgctcaagcactgccacagtggcgagaacctcatcttcacccggtcggatttcctcaatccgcaaggctcggaactgtttcagcggctttcagccttcgatgacctttacgttcgcgattgggcggcacggcttgcgctggcctgtggatcgaattccatccgcataccgtcgatcaaggcgatcctgtccgcggccgcagggctggaaatgagtccggtaaccggaggtctgaggtggcttctctatcgggtgtccagtggagcgccaaatatcacacccaatgcccggccgaagcctgccgttcccattccttctgatcgctccaagccggtggttgccagccgaggcgacgatccgatcaatcgcctgagaaagctgaagaccgctctcgacgagggcctgatcagccaggccgactacgacggacagaaggccaagatcatggaaaatttctgagtgatccaactatcctgccactccggtccgtcagaatgacgggggaggaactggctcttcacttgcggtatcgtctgatattattgtggcgatgaaacctacggctgaatgcatatctcggggagggagttccatgcctctgtgtctgaaagatgactttcttcgcatgctcgcgagcgagattcgcaacttctgccattggatgacctatgcgcgtctccgcaggcacgtcttgcgcaaacgatagtcagtcggcatctgcccccggcaccggggcgactttccgtattggttccatcactagccttcgggcggaaaagcccatcgataggccctgtagaatagagaatcgccgcgcttaagtgccccttggatatggcgatagcgtctcggagaaacccgtatcttcgaatcatcgaaaggccctatgtccggtgcgatgatccggatgaattcgagagcgggtgggtagccgcgtagagcagaagcaacggtcatggccttaatggtttctcccatttggcgccagcgttcgaccgatgcttcccgtagatcttgatctgaagtgggcgtaatgccgtcgctgttctcggcagccatactcgtgagcgggatcgacctcgtgattcccatgcgggtcgctacggcgctgaacgtttccccagcgcccgtccgaatggcaccgccaatagctttgatgcgaggcaggagatgtcttttcgaaatcccggaaagggcgcgtaacatgtgatagctggtatttcgtgcggatttaagtaccgctcccaaggtcgccatgacaccgccgcgcggactctggccttcatgtccgtatcgaggccgcatctcattggtggggtgatagaaaacacctgttcgaacatcaggtggcgccccatctctcgcccggaactgtgccgcaggctcttctatgggcatatccagacttccgtcacgccgcccaatggcctccttcaatgcagagcccaaagggcgattggctaggaatgtcaacgcgtcttgctctcgctgactgcgctcctcaattgacttcggtggcagggctaggggagacatggcattggcgatgcgagcggcctctacccggtcaagaccaaggttttccatgacgggctgccattcggacgggccgccgaatgccgccagcagaaaatagtcacgctcgagtgtgcggagatcctcccagcttcgtcggctgcttgagtgtgtgggcggagtgtaatcggcgcacatggggcaatctttccactgtctgtcccgctcgcctttcgtgccgcggaaggttgtgacctatccccagcactgctggtttcgattgaagggaaccgagtgacgacgacgacattaaccgagcacgaccgctccaacatagtaggccacgccgagcccaatgacgaggatcgccatcaggatcagccgcgcacggcgggcgcgccgctgaagaacacgggagggacggggccggaggtcagacatggccctcggcctcacgaacgagtgcagccagcaggcgcttggccacgacgtcaggcggtaattcgccaacctccagcgccttggagccaaactcggaggtaaccaccaccgtctcccctttcaactcgcatctgccgatataggggatttcatcgatctcaacgacaatatcgtgcgggccaatcatggcggttgtagctctcgacaatctccgaacccgatcggacacctttgcggacaacgctgagccacactcatcaagagccgataacactgcttcggccaagtcgggccgatcttgtgccacccgaccaagcagcacgacggcgtcgtcgtcggcaatgtcggctaaggcatcgattacttcgtggttgggcgccgatgctaacgcttcgctcagcgcctctagggcatcaaccttcccaaatcgcccaagggcgcaggccgcggcaatgcgaacgctggggtgcagatcatcttgaagatccaacaagatagcgacaacatcaggatctaagcgtgcgctgcgacaggcatcggcacggacatcgggttcgtcatggcgcagcaaccgcatcgtcacggcggcaggcagggtgacgccggttcgagctgctgcggcaacagcaagtaccaacccaggcccctgaaccatatctcgtgtgatgatccgctccaccgcagtcgccgcctctgggccgccgatttcaaccaagacttcaagtgccacggcttgctcgcggatcaaggcactgaggccaaagccagagaacctcttgcagataccctcaagggctggcacagccgccgtcaatttacgccgcccacattcggtcatccgggcgaagatttccgcaatcccagcggttgcgattcctgccaccaattcttgatctggtaacgagctgagatcggcaggcgcgcggccatcggcccgcgatgaaggcttcgccgatggggctcgctgttcaaagagatggagctggcttttcgacatggcggtgatgatgccaattttctgcaaaagagagaaggtgtgaagttcgccgaccaaaactgttggcaacactcaaaagtagagcgcaatctcctttctcgacatcaagaatgaagatggatgcccaatgggcgagaggctggtcatgcttaatgccgactcggcctaaagtgaggatcaaggcttatctgccggaaccataatcagctgttgcgtgaagtacgggcagtcattggacttacgaaccttccacttcccgttggcaacgggacatagcgttgtttagataacaaccaccgccctgcctctaccgagtgggaaacccaccggccacctttgccgccagcggcaattcgcaaccatccagcacctccaggacagcatctgctaattccgctctgtcgcgggccacgcggcctagctgcacgatggcagtgtcatccagcaccccggcgatcgcctctataacctcgacggtcggggcttttcaagcatccgcatcaggacaggcagggcctcagcacggcccatatgtcccagcgcgcaggctgcagcaccgtgtacaccagcattgagatcgcccagtagctcgatcaggccgttgatcaccaccgggcttggacgcgcgcagtggcaggcgtcggcacgaatggctgggtcggcgtgccgcagcaagtccgtgaccgtggtcgtcggcagggtggcggccaattgagccgccgcccatactgctgtcgccaaggtcggaccttggacttcccgccgctctataatgcgtgcaaccgcagcacccgcttccgctccgccaatcgccaccagagcgcccagggcggcgacctgctctcgcactggggcgggcggcggcgaacccggtgaaccggcgaattacctccgccaatgcgggcacggcagcagccagtttccggcgaccagcctcctgcatgacagcctcgacatcggagatcccgacttgcgtgatggcggcaagcaattcatcgctggtcatgctggcgatatcgacagcaggtcgaggcgccggcattgaggcaggcgcagctttagccgcatgcatgcctcatcgttgagccaaagacggctccgcttgggctgctttggtggcactttaagcccctcccgccgccagatccgctcgacccgcttgggattgacggtccaacctgcgtcacgcagcagggccgtaatccggcggtagccatagcggccatactggcgagccagggtgatgacgtcggcggtcagtgcctcttcatcatcccgatcctgtagctcacgtcgctgcgtcgagcgggggctgtcccagcactatccacaccggatagcgaggggaggaggtcgaaaagctgctgcctacagactggctcagactattcgtacgagttcggcgtggcattagtatttagctcatcaaggagatcttcaagaagcccctgcaggatgatggctggcgaatcgaaatcgtgagcgataaaattggcggtattttccattaggtttgtttggctttgttttgaatcggttattaaagataggttagagtctggcgcgctggactgtttcaccccctgctcaagacggttgttcctggcagagttggacggttcttgtgcgcgtggtggatggttttgatttagctgtaactggtagacatttgatcttccccgtcgctccccagggaattgactgtttttgttaccgccaccagcggtgtaggtaaagtagccgcacagaagcagtgtcttgatcgcagtagcaacggccgccctcgacagcccgacatccgatgcaatccgctcgtagcttggaaagcattgcccgttttggctgtttattcggttgataagcgcaaagccgactctgcgtgagctatcattcagtcgagggtccttcatgatttgtgacagcacactcattcgagcggccaatgagtacggcttttgcgcctctgtcattgtgattcgatccaggcttggacggccgaacttttccagcgaagaaggcggccaatcctgatcggaggcgggacagcatcaggattggccgaaagaaagcaataaagcgatttaaggcttggaagcctcagaatcgtcataagctctccgggggtaatgaggtgatccatgtcgtgctccatgttgcattgaatcatggtagcgaaagtcactataaaaagtgaagtgggggtctatttttttctgcaaacagatcgaacgttgtttgtgaattggcagatttatgggctaacccggcgctaattaatgcggaatcgaaacctgttaccagtgagttggtcgtcgcctcgcgtacacaatggaattttgatctgggagatcgcttcacacttggtgtcagcatggtgatgaagatccgaaaatcgacatcctgtcgccagatgggcataggatgtcgattttgatggcgattccggacgggttcgtcgtgggcatggtggtgaaaatctcgccgtcgagctgacctgctcgggaactttcctccggcgaaaagtagagcctttggcaaagttatgccgtctggcgcggtgtgggcaatggggccgggctcggagccccggaggggcggagaggatggccccattgccttgagtttggcggcgtgcgccgccggggtctggtatcccagggatgagtgtggtctggcggtgttgtagtcgtccgcccaggcggcgatgacggcccgggcctggggcaggctggtgaagaccgtctcgttgagcaactcgtcgcgcatgcggccattgaagctttcgacgaagccgttctgcatgggctttcccggcgcgatgtaatgccagtcgatccgctgctgctgtttccaggccaggacggcattggacgtcagctcggtgccgttgtccgagacgatcatctctggtcgccctcgccgagcaatcagcgccgacagttcacgggtcaccctggcccccgagatcgaggtgtcgggaatggcggccaggcactcccgcgtcacgtcgtcgaccacgttgaggatgcggaaccgccgtccacaggccaattggtcatggacgaagtccagcgaccagcgggcgttggcgcgggcctcgaccaggatcggggcacggctgccaatggccttgcgccgggtcttacgcttgcgcaccgccaagccctcctcgcgataaagccgatagatacggctcagtcccgatggctcccccgtctcgtgcagcaggatgaacagccgacgatagccgaaacgccgccggaggttggccaagtcccgcaggcgggcacgcagcgcctcgtccctggggcggcgcgaccggtagcggatcgtcatacggtcggcggcaatcaccgcacaggcccgacgctcgctcatctcgaattggcttcgcagatgggcgacagcttctcgcttggcggcgggcctcaccatttttttcccagcagatcgcggagcgcggcctcgttcagcatggattccgccagcagcttcttcagctgggcgttctcgtcctcaagcgctttcagccgccgggcttccgacacgtcgagcccgccatacttggccttccacttaatgggatggacgtctctccccccaagcggcaacgcttgcaaaggggcgcatcagatgttggaggagatcatgacgatcacatacatgggtatcgatctggagaagagcgtgttccaactgcacggggcggatgccgatgcgcggcctcctgctggaccgtggcttcgcgatcggtgcttcgatcactcgagcccggcgcgccatccccgagatcatctccgatccgaacaacggtttgaccaccatggctcgggaaaccatcacggaactccacgagtttcttggtcagatcgaccagcggatcaaagcgttcgaccgtcgcatcggggagatcttccgcgcgaatgcggcttgtcaacggatcgcccgcatctttggcgtcggccccaaaacggccaccgccgtgatcgcggcggtcggagatggcaaggagtttaagaatggccgacacctttccgcttggatggggcttgtcccacgacagcattccagtggcagtcgatagattctgatggggatcagcaagcgcggcgatcagcacctgcgaaccttgctcgttcatggcgcgagagccgtggtgcgggtggccgcgagacggagtgacccgttcagccaatggatcaatgcgctgcgagagcgtcgcggggcgaaccgggcaattgtcgccgtcgccaacaagaacgcccggatcatatgggcgatgcttcggcgccatgaggaattccagcccgcaacctgaggctgggatggaggttgcatggagatctacgaaacgtgaccgaccggcaaatccggtgtgtgaggaacctggcttttataacggccccatgaggccgaccacttgttgaggctcaccacgcggaattcccatttgggcgcaccgacatccggtgacgccggatagatgttcgcaacctgggatgcggtcagaacggctcgaagaaatccttgcgacaggagagacgtccatagatgtagaaggtggcgctcgatatgccatggcggcgacacacatccgccgtcgcggcaccggcctcctgctcccaatgatctgctcttccgaaaacctgctccgcttcatctcgtccgtcctccgatgggccggactctacttcaaactggaggaattttcccaaggcaggtcagagcaactcgtcgcggagcttcccattgaagggttcgcagtaggcgttctacgggctaccgggttcgataaagagcgtccccatctccactttgccaagccattttcacacggcaatggctgtcatttccgggccgatttcgctgcgaatgtacgtgggcataaccacctcagcgcgccagaaaatatacatctgctgtcggatgacattcacgcagggcgattgatgccatcgacacagctaaaatagaacgctatgtcgcgctcgagacattggcattctcagaaattcgacgtgaaatcgacatcctgtcgccagttggcaataggatgtcgatttttgatgttttaagttagtcaatcccggcagccaaaatgagagatgtcgtcttcacattggcggaaggcggtgaggttggccgtagaaattgatttagttgacggggtttcaaatgggatggttgtccagtgcagccaattgaagatttctgctctggagttctgtctttccgtctggttccagttcattgcaaaatcgacatcctattgctatctggccataggatgtcgattttgaatgtgatcagataattagggctgcggctattagcagtgtcgctcgcagctgactgccgggactatatggcgttagctcatgtggatagtcatgcttattgaggttccatagcctccttcggagtgcgcggccagcagtccagcgctttgcgggtcgacttgggcgatgatctcgtgggcatcgagcgtttcttggcgttgcagcatgtctgcgatgcgcaagaccgttgtcgagttccatcgaatcagatttagcgcctcctgatacgcctgctcgagaatgcttgaaactttgcgcgccaagtccgggcgggtactgagcattggtccgatgctgtcgatgttcggcatccctgtccataccagtggcatttgatcgtccatgcccattgctgtcaaagagaccgtcgccaagactgtcgcacgtgccagatccgagcttgtgctgccgccggagccagtcgacacgctgccaatcaatgtttgttctgcggcgcggccagcgaggaggtgcatcagcatgaaattgatgtcggagcgggtctctattgatccttgatcaagtgaaatcgtcacgccaccgccgctttcttccgtctggcggatgctggccatcaccaacatatcaggacgatgaagcgcaatcacaacggcgtgaccagcctcatggatcgcgctgcggcgcacaacttctgcaggagccgttctgatttttccacggatctcagtagtcaaatcttcttgcaccatgggcctgttcgcattgcgcgcacagcgccgagcaccacgcacccacctctcaatatctgcgccggtgccgccatacgccagtttggcgaggtccttcaagtcgatgccgtttaggtcctggccgaggtgatagcgaagaatttttccaatggactcctgatcggggagagggatcaggatgccgcggtccagacgtccggaacgaacaatagcggggtcaaggcgctcaggatggttgcaggcggcgacgacgaccactccctcacgacccgtaaccccgtccagcaattcaaggaagccattcacaacctgcacgctataatcccggtactcgcttttgaactgggaccggtttccgaatccatcaacttcatcaatgaacaggatcgaaggagctgccgcccgagcggcatcaaatgttgcccgcattgacttcaagaggtctcccaaatgaccactcgattgccattgcgcgagcgatgcggagatgagaggaaggacgcatgagccagccagggcgcgcgcaaaggtggttttacctgtgccgggcgggccgaacaaaaggcatccgcgatcaactgcggaccaaggaattcgtccagctttaaactcaatgaggtcggctttcaggctctgtccccaggatgttgcctccggcatcccgaagagttggtcaagggtgatggctggaacttggttccgcgtctcaacgagacggcgcagcctctgcaaaatggtatcggctccgtcgccagggcggcttgccaaggcaatatcttcgatgtcgcagcgacgtgccaattcatcggaaatgggctcggccggaaccgagttggtcattgtcaggataatctcatgcagggttgtggagtccaggggcggcacaacaagccggtggtcggctacccgcaacaaatcctttggcaggaggcgatcgggaacatgggagatacccagcacagagccgccaccggccaaggttgctgctacggctccatttccctccgactgggattcgcccttcctggtgccgctccgcttgaattcaacccaccgccccgcaggattcacgcatccccatcgccaatcattggaatcgccgctgacgtattgtgtgccgggtgatgtcaccatcagttgccaggcattggctatgggttccacccaagtgctgctcggaacctcgatgaccacggctaagcccgattcggcaggcaaacagaggctgggatgccgttgcaggacgtgcctcagagcaatttcggcagcgacctggaccggattcttgttttggacgtctgtggcttcgagcggaatctcgattggatcggtaagagtctcctgatcatctttgggcatgggggggcatttgggctttctgggcgccatggtggacctcagtttattttggaaggattaggctgtcgccgggggcgaggtgatcagtgaatgttgggttgagaatcctttttcaggcgagggatccacgcttgagggcgatctccccagctgcctgcagtggcaaggtcgatcccgcgcaattccgcttcgagcgccgccatccgagtgacaatctgccatcgctcgacgatcctagccgaatcggccgtaattaatgccatgagaacctgagcggacgtgtatggccgcgaattcaatccgcgattccagcgggatgccgccgacttttcaagtccgagtgggagggaaatctcctgaaggtctggttcagttggaaaagcactcctcagggtcttgagaaattcacgaggggtcgggaaaagcagaggaagggcaaggccaggcgttgttgcaatgaaccgcagcaggatcgccgtcggggcatacaccaagcgtgccatatcgtcgatgtcctggtcagccctgaagcgacccgtcttctgctgggtcaatccaagcatgccacgtttcagcaatgagggaagttgcagcgccttaagactggtaagaagggtgtctgttgtgatggggaaatcttggggcaggttaagcatagtgggcgtccttatttagatggtgttgatagcgtcaaggtcctgcatctcgagtgcagcaaccatggcggtataggtgatacgaggaagggggcgggcgtgctggttggaaaatcccaaggcgttgaaacggctcccttgccaaccggcaaatgggaggatgacaacgtgatcggctgaagccttcagcaggcgaggaatgtcacgtccatcgcgggttccgcattcgatggcaatccggccatggcgagtctcggcgaaaatatcgatcaatgcatgggccgagccacaggggacccaatgctccaacgatacgcctgcatgcgggtcgattgccttcgccaagaccagcccaaggcggcggagatttcgatgcgcgggaccttcgttgccatgacgcgcgggtacgagcaattgatcgatcgcatccgggatcaggatctcgatctccgacactgcgatggattgggccgttataagcatttccagcatgcggctgtcgcagtctgcgcgaaccccgccggtcgccgttgcatggagaatctgcgcgagtgtgagatctgggcgggtgctaatccatgtactttccatatggtgattcggagagagcattttgatcctcagccagctttagaatttggtggtcggaattcgtcattacccctagagtgtaactgcaagcgcctcaggtgtcaacaccctgggtgcaatattttacacctgaggtgttaattgctgactggggaacaaattcgcgcggctcgagctctgctcaggtgggagcaaagggatcttgctgaagcggcaaagctgtcgatcgagacgatcaagcgcctagagaagattcatggtccggtcggggggcttgcccgcacgaccgatgcgctgcaggcggcgttggagcaggctggtatcaccttatttggtgatggacgatacgaaggggagggtggacccggcgtccggctaaagcagcctataaaataagctttgtatcgattggggggggcatttcagccagggtgcggatacagctcaaggctcacatcacgtgctcgcatccggcatcagccggcattagtcagccaccttgaaaaaacctaagcgtataggttatcgtgtatcatgaagttgtttcattcagccggtgccaacgcgcgtgtcgatatccagactgaggatcattgcccgccacatgtgcatgcgttgaactgggcggaccgctgggaagccaaggttgagatttcctttgtcgataacaacgtggtgctgatggaggtgctgcctgtcgcgaacgagccgacgaggcgaacccttggtaaactgctggatgaagttgggcagcacttggatctctgccgacgtgggtggtggcggatttacggggatacctgcctcgtcaacaggtggatcagggtttcggcggagggcgtgccagccgtattgaagaagggcaggaaaggggcgtcacaggtcttgggggccaagtacgatcccggcagcaccgtcctgacgctggccatgtcggacgggtcgacggtgagcatcaacgcaggtgatggagaggttgaacgatgaacgggatccaagtcacgagcgaagaactgtcacaggcgatcgaagctgggcaccgccgcatggtgacagagtttcgcgccggttcggtgcgctatgatcccgtgcgggacgccatagaattaaccatggtggacggctggggtctggtcttacttcgttcggcagtggccgaacttgccgagatcccgtcccaagacatgggcaagctggagatctcgccggtgggcaccggtcttctgctagacgcccatgacattcacatcaatgtccacggtctggtgaccgggttcatttcgccgcatctgatggcctcggcccttggacgaaagggtggatcggcgtcctctgacgccaaggcgcaaagctcccgcgaaaacggcaggaagggcggccggccggtgaagacgaaggtcgcttgacccgggccggaccgagtccatcgaacgatggccgaggagagagagggcctgtacaagattcattgaaacgctgaaacataattgcgctgccgccgtgtgggctggcgcatttgactccgctgtagccgtcaacgaagtaaaaagcctcaacaacctaactaccagggcggccgaggctatccccggcaggtcgatgcggctcagaccgcgaacggctcggccgtgacggcgatcagcgatagggcgtattaaccagatcgccgcgggcatctcacctatcgggctgcgtatcggtcctcttcgcgtgcccgaaattctgatgacctcgtcatcctgcggtgctagaattttttgcgaacatcggggtgtccgtgtcctctcttttgctccaaatttgctccaatgcgagcgggaactagagaggattggagaggactcgacaggacggaatttggcaggttttctggggtttgcccggcaaattggctctggtcaaggggataagcttcgggctcataacctgaaggtcgcaggttcaaatcctgcccccgcaaccaaattagcccgcaatctcaataggttgcgggctttttgattctcggccccgtgtccgtgaaaatctgtgtccgtaccgtgtccgtttgaaatggcgcccagaggcgccgttttgccgcttctgaccttcccccctgaaaccggtccacgcggagagtgagttcccataacctgaaggaaacagaggaactcaaatgaagcgcagtcgatttagcgaggaacagatcatcgacatcctgaaggaggccgaggcgggggagatgcccgccgtatcggtatgccgcaagcacggtgtctctgagcagaccttctaccgctggaaatccaagtatgggggtatggaggtgtcggaggccaagcggctgaaggcgttggaagacgaaaacacgcggctgaagaagctgttggcggacgccatgctggacaatgtcctgctgaaggaagtcctcggaaaaaaaatggtgacgcccacggcgttgcgggaagtcggatgctggctgatgtcggaaaagggcatcagccagcgccgcgcctgcaacctcgtgggccttcaccgttcggtggcgcggtatcggcatcgccaccgcgacgacggcccggtccgggacaggctgaaggacctggccggcgggcatcgtcgctacggctatctgcgcctgcatgttttgcttcgccgggaggggctggtgatcaatcacaagcgaacataccgcctctaccgcgacgaggagctggcggtgcggaccaagaagcgcaaacggctggcgggccgggagcgcgtgccactggcggcgccggagcggcgcaatcagcgttggtcgatggacttcgtttccgacagcctgtgctcgggccgccgcttccgggtcctcaacattgtcgacgaacacacaagggaaagtcccagccagttggtcgacctgtcgatctcgggtgagcgggtaacccgccggctcgatcagttggccgctttgcatggcctccacgaggagatcgtcacggacaatggtccggaatttaccagcaaggccatgttcctatggtcactgagaactggcgtccaactccgcttcattcagcccggcaagcccatgcagaacggctacggcgagagcttcaacggcaagttccgggatgaatgcccgaacgagaactggttcaccagcttggccgaggcccgccgcctcatcgagggctggcggcgctattacaatgaggagcagccccatagtggactgggttatcaaacacccgccgcctttgcggccaagcaacgtggtgccgtcctacggtcgccttcggctcgtttcggcaaacaccacgtcgccagcactccagcaaccatggtatcaaccaaaacactcaccctctgagtgggccgaatcaggggggaaggtcaaatgtccccttcatggtcagttgaattattccattcaacctggagccattcacggggggagggtcactgctggcgcgagtttagctgatgaaaaatcaggaaggagtctctcttagtggttgtttgcgttgagcgctggctaaggagggcgggaaatgcgccatggcgcaagtcagcagcgggccggaagcagtccgtcagatttcggggggggggcaattgaaagccggacatcggcgcctcaagttcgatgaacgcgccttaattcggggctgccagaccgcagctggccatatcgagccgcaacgacgatacttatggcggttacttgctcggcgccgtagccccggtgacaccactccgtcaccgcctttcgaaccgggcggaaccgcgttatcgtggtcgagtggcgcggtgcatctggaagcgcagggtttatgtctgacaaggcccgcattctgtttgttgacgacgatatccgggttctcgcggctttgcgccggtccctgtatccccaggtcgcgcgctgggagatggagttccagtcgtctccggaggtggctgtagaggcctaccgggcgtggaggccccaggtggtggtgaccgacatgaaaatgccgggcatgaacggcctccagatggttatggccatgcggcgcatcggtgatacggcacgttatatcgttctgacgggcacggccgatttgcggacagccatcgacgcaataaaccaggcggagatattccgttttttcaccaagccctgtccttcttttttgttggtggagggaattcaggcggccctggccgcggcagcgcccacatccgtgcccgcggcagataccctagccgatacggccttggataaactgcccgtcgctgttctggtggtggattccgaggcccgcatcttgtttatgaatcgtttgggcggtgctctcagtgcatgcggggacggtatcgtcatgaatgcgcgaaagatctgccgtgcctcgaccccagccgataccgtacgtctgcatgcactgatcgaatcggccatccggaatggagacggtggcgtcatgaccttgccgcgctcctgttcctcgcccctttcggtggcggtcagcgccttggaaagcagcggcgacgccacgccaaaggcggtactttatatatcggaccccgataatcatcccattcccaatgccggtgaggtgatgcatctgcttggcatcacctcggccgaagccaggctcactcatgccttggcgagaggcttgtctctcgatgaggctgccgaggaagctggcatcaccgtcggtaccgcgcggggttacctgaagcagattttcgccaagaccggcaagacgcggcaggctgaattggtccgcctcgtcatgagcttgccggtaaccctcccaaatgggagtgttcccggagctaaataagatagactatgcccaaggtaggtatgtagccttgcctaggagcgtggtcatggcgatatcccagtccgcgaagatcgttcggcaattgcttcccacgtcagtgatgggagtcctgtcgtcgctggctcttttcgggatcgtttttctggtcgagcgtgacagctcggaaagccgcttcgcagagctggccgagcagcggattattgccatccgcgccaatatcgccatcgcacaaggcagcgtgaaccttctggcggctcacttcgccgttgcccccgccgggtccaccagccgggagggcttcaggcggttggtggagcagaccctcaaggatcatgacttcattcagggctattcctgggacccgcgggttccccatgaccagcgcgcactgtacgaggaggtggcgcggggtgatggtctgaacagtttcgtattcaccgagcgtgatgccgagggaggtttgcgcccggcggtccagcgcgacgaatacattcccatctattacatggagcccatggcctctaaccggcccgccctgggcttcgatcttgcgtcgcagcccatccggcgactggctctcgaacagggccgcgacaagggcgcgccggaggcgacgggccggatcaccctggtccaggaacacggcggccagtacggcgtgctgatcctagcgccagtgttcgacaaggcaggccccgccgacccctattcgaaccggcgctcgctgacgggctatatttccggcgtattccggctgggtgacctgatttcctcctcgtccagcagcgcggccgtgaccatggcgctgcctatggtcgatatccacctgttcgatatgagcgcggccgagggggagcggcgcctgtttccaaagcaggatagtcgcacgcccgatgcgcttgccgcgggactgcatatttctgaatccttcgccatggcggggcgttcctggcttctgcttgccacacccagcgaagccttcgtcgcggccagccgtccggcggcgtcctacgttctgctggtcgtcgccttgctgttcacggccttctacctgttgctgttgaagagccgcatcgcccaggccgagaaggccaccgcccttgcccgtgagatgggccgtgccaagcttcgtcttggcgaggctcagcggatcgccaagttggccagtgtggaactggacctgagccaggggcttttcacgacgggagacgatgccgtcgagatgctgggcctgccgaagagccaaaccggcggttcggtggatttcttgctccaatgcgcgcatcccgacgaccggatgatggttcgcgatgccttgattggtgcggccgaccaggccgttgacctggaattccgcatcgaggtcggaggcgaggtgagggtcctgcatgccctggccgacgatttggccgaagaggggcgaagcatcatcacgcttcaggacatcacggcgcgcaaggcggccgaggaggaacgggcggccatgatcgagcggatcgccgaaaccgatcggttcgaggccctgggcaccttggccgggggcatcgcccacgaaattaataccccgacccagtatgtgggcgacaacctcaccttcatgaaggaaagtcaggccgagttgctggaacttgcccaggccgttcgattgggggcacgggacgaccgcgactggcaatccatcgccgacaaggccttggcccttgatctggatttcctggcgacggaactgccgaacgcggcggatcaggcgcttgatggtaccggccaaatcgccaagatcgtgcaggcgatcaaggagttctcctacccgagttccaagagcgcccatccggtcgatctcaatcacatgatcgacgtggtggccaccgtcacccgtaatcagtggaagtatgtggccgagatggactgcgacctggatcacgatcttccgaaagtctcggcggtcgagggtgaaatcaatcaggtccttgtcaatctcatcgtcaatgcggcccaggccattgccgagaagggcggagatgcccccggtcgcatcacggtgcggacgcgcagattggagagcgaggtggaactgagcgtcacggacaccggcatcggcattccggccgccaacctgaagcagatcttcgaaatgttcttcaccaccaaggcaccgggacaaggcaccggacagggactggccatcagccggtcgatcatccaccgccatggcggccaaatctcggcggagtcgcaacccggtttgggtgcctgcttccgtatccgtctcccgctgacccagcctcaaggagcctgagatggacagggcgctaccgaccatcttgttcgtcgatgacgagaaaggcgttctggacggcctgcgccgcagcctctatggccagcgcaacgagtggaacatgcgcttcgccctgggggggcttgaggcattggccattctggaggccgaggcaatcgacgtggtcgttaccgacatgcggatgccgggcatagacggagcggccctgctcgaccgggtgaggaccctgcagcccgagacggcgcgcatcgtactttcgggcttttccgagcgggaggccattttccgcactgtcggccccgcccatcaatactatgtcaagccgtgccagccccaggtgctggtcgaagccatccgccgcgcgctgagcgtccgccgcacgttgcgtagccccgcgctgctggccctggtcgcaggcgccacgtccatccccgccttgccccgggcgttgaccgcgctgttcgccgagcttcagtcgcccaacggttcggcctccgaggtggcgcgaatcatttcctccgatgtcggtttgaccgtcaatctgctgaagctgaccaattccggcttcttctacattccgtcggccatcaccgatgtgcttcaggcggtcaagatgctgggctttgaaatgcttcgggccttgacggtgatggcgggtatcttcgaggcgttccggtgctgcggcatcgattgcgacgtcttgcgtcaattggaacagcgcagcctgcagatcggtgcgctggcccgcaagatcgccgaggccaacgggcttggccaggcggccctggaccagacccaatgcgccgggatgctggcccatgtgggttcgttgctgctgttttccaactggccggacgtcatggcggaagtgcgccggggattggatcgttcgggcggcggcatcatcgccgcggagagggatgccctgggcgcgacccacgcggaactggggggagttctgagctactccccattggttggacagaattcggggaagtttaagctactctccgggcctgctgatcggtttggttgatggtgttccagtagaccacggcgggggtccttccgccatgggcggcgtggggccgtttgtggttgtagaaggtgatccagggtccgatcccggcccttgcttgcgagccggtttcccaggcatggagatagacgcattcgtattttagggaccgccacaggcgctcgataaagacgttgtcgatgcaacggcccttgccgtccatggagatgcgggttccggcccgcttcagccggtcgatccaggcgaaggatgtaaactggctgccctggtcggtgttcatgatctccggcgggccgaagcgcaggatggcctcgttgagcacctcgacgcagaagtcggcctcgagcgtgttggagatgcgccaggccagcactttccgggtggcccagtccatgatggcgatcagataaaggaatccccggcgcatgggcagataggtgatgtcggcgcaccagacctgattgggccggtcgatccgcaggccccgcagcaggtagggataggtcttgtggcccttggcgggcttgctggtgttgggcttctggtagatcggcatcaggcccatgagccgcatcagccgccggacgcgcttgacgttgaccgggtggccctcgttctggagatgccaagccatctgacggacaccatagaacggcgtttccaggaattggcggtcgatcaaccgcatcagctccaggtttgcctccgtctcgcccaagggctcgtaatagaacgatgatcgcgcaatggacagcaggtggcactgggcgccgatcgacagcgccgggtgtttgggctcgatcatggtccgcctcacttgccggtccacggcttgagctttcgagacaaaaaatcgttggccacggccagctccccgatcttggcgtgcagggatcgcaccgtatcctcgtccacctcggccttcttcttggccccgcgttcgaagatctccgccgccccgtccagcagggacttcttccattgatggatcatggtcggatggacgccataggccgacgccaattccgataccgtccgctcgcccttcagcgcctcaagggcgacacgcgccttgaaggccgcgtcatggttcctgcgcttcgacatctctgatctcctcgtagttggggatcagcaaacatcagatcgtagcttccgtcagtgtccaatttccggggagtagctcattctgctggggctgtggggcttcaccgatccggtggtcgaagccgtgctctaccaccacgagcccagccggtgcgaataccattccaacgcggaattatcgcccctggtggcggttcatgccgcccagcatctgatcaagccggttcctgcgggagccgattccatggccgcctggacggacggtctggacatggcgtttctcgggcgggtcggcgtcacggcgaaaatcgcgtcctgggccaagatcgtcgataccgtccgtaaggaggacacatgatgtccgaactcagcgacaagatcctggtggtcgatgatgacgccaacctgctggccggcatcaagcggcttcttgggcaaaagctcaacatcaccaccgccgagggcggcatcgaggccctgggaaaggctcagaatgaagggcctttcgccgtcgtggtgtgcgacatgcgcatgccgggcatggacggggtcgaagtgctgcggcggttccacgaggcctctccggacaccagccgcatcatgctgaccggcaatgccgatcagaagacggcggtggaggccatcaataccggccagatcttccgcttcttcaataagccctgctccatggccgtcttgaccgagggcatcctggccggcatccggcaatatcggttgatcaccgccgagaaggttctactggaaggaacgctttcgggcagcatcgccctgatgaacgacgtgctgtcaatggtggcgccggaaagtttccagcgttctctacgcctgcgcggctggtcgctgcagctcgcggcatccatgggcatggactctccgtgggaactggaactagccgcgaccttggcgcggatcggcgagatctcggtgccgccggaagtgctggcccgccatcggtctggacagcgtctgacgccggtggaggaggaaatgctctcgcgggttcccgagacgggggccgccctggtccgcaagatcccccgcatggcccaggtggccgaggccatcgcctatcaggacaagtggttcaccggcaagggattgccgcaaggcggcaagtcggggcaggacattccgctcaatgcccgcattctgcacgtcctgctggccttggatgagatcggttcgggcgagctgacgcgggccgccttcccgtcactggaaaaaatgcaggggcgtttcgacccggcagtgctgaccgccgccgcccgcggcctatccgccatggttgtcgacgaagccgccctcaccagactggagatccccagtaccgggctgcgtcccggcgacatcctggaggtccagctggaactggaaaacggaaaactggttctggccgccggccagaccatcaccgacgccttgttcgttcgcctgcagaatctgcacaaaatgtacaaattccgcgatcccgtgcgggttcgtcgcgccggtcggctttagcccgccgagcaaaggagtgtgtggaatggcatggacccctttcaagacggcgctgaccgcgatcatggtgtttggctggcatgccggggagggtagggccgagcctgccacctacaccctggcggtcgtgccgcaattcgatctgcgtcggatcgaggcggtctggcgccccattatcgatcatttgcaatcgacgaccggggcgcgcttcactctggtgaccgagaccaccatcccggtcttcgaaaagggactacatggcggtacctacgacttcgcctacatgaatccctaccactacgtggttgcccatcagcggcagggctacaagccgctgatccgcgacgtggaggagaagctgtctggcatcgtggtggtgcgcaaggattcaggcttgaccgaggttcggatgctcgacggccgcaaggtggcgtttcccgctcccaacgccatgggcgccgccctcattccccgcgccgaattctcgcgcaagctggggatcaggattacagagctctacgtcaaatcccatgattcggcctatctcaacgtcatgatgggccaggccgatgccgccggtggaattcgcgccaccttcgaccagcaaaagccggaagtgcgtgacgggctgaccgtcatctacgagaccgagcgctataccccccatcccctggcggcacatccccgcgtgcccgccgacatagcggcgaaagtgcagcaggccatgatcgccctagggacaacgccgaaaggcgatgccctgctggacgggattcccatcaagaccatagggattgccttggacagtgactacgatgccttgcgcaacctcgggctggaggcgttttacgtcgaacaatgagcatccggtccaagctcctcattcccctgctgttgctggcggcctgcgtattggcgtctatgcacttcatcgcgttcgatacgctgaagaagacgctggtggccgagcggatcagcagcgagcagcgcgccctcagcctgctggccctggcgatcgcccctgacgtgcaggccagtgacctggccaagatccacgagaccatgggcgagtcgaaggcgcagcattcctggtggcggtccttgaccttgaccagcccggcaggattgcgtctttaccccttgcttcagtcgaacacccagccgggctccaaccttcgccttaccgctccggtcagcgccgccggccgccggctgggagagttgagcatggaggtcgaccaggaaaccctggtggcgcccgccctctcggtggtctacggtctggaagtggtcgtggccctgatcctgatcctgggcaccatggcggtggtggggctgcagacccggatggtcatttcgcccctgcggcggctggtggaggccagcaaccttctgtccaaggggcagtatgacgtcgtcctgccgccttcctcggcggacgaggtcggcaatctggtttcggcgttcgagatcatgcgcagttcggtggccaatcgcgaagcggccctgaccgaaagcgagggacgtttccgcgatctggccgaatctgcgtcggactggttctgggagaccgacaccgattatcgcctgaccttcgtctccgaccgcatcggtgccatcctgggggtcaagccgtcggccattctcggttacacctatttcgacgtggggctgtccgatttcgatgcggacctggcccggacccatgccgacgatctagccaaccaccggcccttccgcgacctgatgttccatatcggtccggtggacggcaaggacgagaagatcgtgcgcatcagcggcatgcccttctacgatcaggacagcgccttcatcggctatcgcggcatcggcgccgacgtgacccgcgaggcgcgggcggaagagcgcgcccgtcaggctcagttggagttggccgatcagcatgcccagttggaacgccttgtcgaagaacgcaccgaggcgttgaagcaggcccaaatcgaggcacttcaggcgtcacgcatggccagcgtcggccaattggcggcgggcatcgcgcacgagatcaatacgcccatccagtatgtgggcgacaatctcgccttcatccaatcggccgccgaagcggtgtttccgctgctgagcgaggcgcgagccctggcggaaagctggcgggttggggaaggcgatgccggcaagaccgaggaattcctgcagcattacgatgcggctgggctcgacttcctgatggaagagaccttgcccgcagttactcaatccctggagggcgtggcgcaggtggcgcgaatcgtcttgtccatgaaagagttttcccatcccggcacgtcgcagaaaacggcagtcgatatcaatcgtgccctggacagcaccttggtggtctgtcgcaacacatggaagcacgtcgcccggatggaaacccgcttcgacccggctctgccgctggtcaactgccatcccggcgagatgaatcaggtcttcttgaacctgatcgtcaatgcggcccatgccatcgaggaatcgggcaagccgctgccgggaaccatcaccgccgaaaccgcgctgtgcggcgactgggccgagatccggatctccgactccgggaccggcatttccgacgaaatcgcccagcacatcttcgatccgttcttcaccaccaaggaggtcgggaaagggacgggccaggggctggccatctgctacgacgtggtggtgaacaagcacggtggtcagattgtggtcggcggagagccggaacatggggcgatcttcaccattcggattccggtaggatgattgccccaagccaccaaggtcagagtgtatccgttttgatcacgacggctcgccacttcagcacaaagcgaaatgcttctggtaccatcagaatctgccccgtagagatgttaactatccgacgattcgattccgcgctttgaaactgcgtggcgtacggaaacgactgctgttggcgatggcgccgcccttcataaatgacgtggatgggcgcaaatgtgaccttagatctccagcaggcaaaggtccatttggggtcagagatccactcggcatcgataggcagggccgtatggagtggtgtcttgggtttttgcgggctctgcatgatcagttctctaacgattttggtcgtagaattattgggcgggttcctggtcggattaatggtggtgtttgcgtccagccgtcaggacggctccgtgcgagttgctggacgggtgactgagggccatgagacgattgcggccatcatctgaaactgatcacgtgacgatctgagacggttccgtcgggctggtgggactgatgcggccatcgttgatacgggattatcagccccggtaggggagggggaagtccgtgtccactttccggggggagttcactcgtcatcgacgagagacgacagtcttgcgggtcgttggtcgctctcgtaaatgggaatataggtattggtgcggccaatctcctcgccgggataattggcctgacgcttgcctccgctcttgcggtaaccgaaatagctgcaggtgatcagcatattgattgcccgggcgactgtggcgcggccgagtccagaatcctcagataagcgttcgtagctcggccagcatgtcctggtgtcttgattgacgcggttcaaaaggaaccaaccgatccttcgtgccgcgtcgttcaaacgcctgtccctggccatctcgcccaccagcagccagcgatccagcagggtttcctttttcacaaccttcatggtgattttccttccttccgtctgcgggggttttggagcaaattcgcgagaggaagtcgggcgtaatcgaagcgcaactaaaactggttgcgcgccccccgcaaccaatcaaaaacgccgcagttcaatcgactggcggcgttttgccgtttctggggccgggatccgaaggggagccgggtaagcaggggggtaagctccgcagtgcaaggtcacgcatgccgggacatatctaccgttcccgcccgctctcgtccttgtacctctgcaacggcgccaggacatattcgatgggctttctggtcccggtcctcacctcggtggagacggccatgccgggagtgagcggaatacgcttgccgccttccacggtgatggcggcctgttcgacggcgacgcggatggcggccgagaccggtgcccatttcatcgaccagttcaacaatccggccaatccggcggcgcacgaggacggcaccggcccggaattgtgggagcagatgggtggccgggtggacgccgtggtggcgggggcgggttcgggcggcaccctcaccgggctgtcacgcttctttgcccgccggtcgcccgcgaccgagatggtgctggccgacccgcgcggctcggtgctggccgattacgtccgcaccggccgggtgggagaggccgggtcgtggctggtggaaggcattggcggcgacagcatccccatggtcagcgacttttcccgcgtcactcgcgcctattcggtctcggaccgggaaagcttcgccacggcgcggctggtgctgaggatcgaggggctgctggtcggctcgtcgtcgggcaccctgctggccgcagcgcttcgctattgccgcgagcagaccgcgcccaagcgggtagcgaccctggtctgcgacgcgggcaaccgccacctgtcgcgcctgcacgacgaatcctggctggccgaccaggggttgctgcagcgagacgagcatggcgatctgcgcgatctcatctcgcggcgccatgacgaaggggcggcgatcaccgtgcgccccgacgacaccctgtccaccgcctacaaccgcatgcgggtcaacgacgtgtcgcaggtgccggtggtggtgggggatcgctgcatcgggctgctggacgaatccgacgttttgatcgccctggccgagggcaagttcggcttcgacctgccggtgagggacgccatgacccgcaagatagagaccgtgacgccccaaacgccgccggaacggctgctgccgttgttcgatcgcggctgggtggccatcgtggtcgatggcgagcgattcctggggctggtgacccgcatggatctgctcaatcacctgcggcgcaaactggcggcttgaccgggacggaaagctggtctttcctatcagtctattgattggatggggttatgctctcaagcaaggcgaaatacggcctgaaggccatggttcacttggcccgccacgaggggttggggccatgtctgatcgccgatgtggccgaggccgagcacatccccaagaagtttctcgacgccattcttctcgagatgaagaaccaggggctgctgtcgtccaagaagggaaagggcggcggctacgtgctggcccgcccggccgagcggatcatggtgggcgatatcgtccgcatcctggacggccctctggcccccattccgtgcgtgtcgcgcactgcctatcgcccgtgcgaggattgcccggacgaggcggcctgcacggtccgcgccgtcatgcaggatgtgcgcgacgccatcgccgccattcccgacaacacctcgctggccgacatgcgggtcagcaaggcgcgcgccgaaacggtgctgatgtacgacatctgaagtatcgtgcgctaaatcagaaacaagctgtcaccctgagccttggcgaaggggctttcaagccaaggcgtcggccgcttcaggctgaaagatccttggcttgcgctcaggatgacagacaaggatttacgctccccgccccgacgggaggcgtcaccgtggattccacgctgaagcggcgcaggatgggctgggcgcagtgatggccggagcgcacggcaaggccctcgccgtcgagggccttgccgatgtcctcggtgcggcagccattgatgccagggcgcgatgttggcgtggagctccatccaggtgacgacgatctcctcggtggagccggcattgagaatgcgccgggtcttttcacgggccgcctcgtaggcgtcggtagagcgggccgccagggcatgggcggcgcggtggatgttggagttctcgtgctcgtaatagcgcgtcaggcgttcgatcacctggcgcggcttctgggtggtggcgccggcctgaagcaggagccgcacaaccgccgcctccacgactatgtccgtgacctgccggagactcgccggctgacctccgtctgcaccgggtcgtgggtctatgcccgcatgggtctgctggacggtctggccgccaccaaccgcaagaaccccgaccggctggaggccctaggcatcggcacgcttcccattgaccggctggcccagttggtgcccacctgccggctcagccgggcccggatcgtcgatgcgggacgcatcgtcaccgctggcggcatcgcgtccggcatggagctgggattccatcttctccgacgggccggctaggccacccatcgcggcgacgtcgaaatcgcgggcaattagttgctcaacggcgggggcgggctcgggcaaggtgaggtcaagacccgctctctttgcaaggaccgccccatgccgcagactgaaatcaagacccgtcaggtggagaccgatatcctggtgatcggcggcggcaccgccggtcccctggccgccatcaaggccaaggagaagaacccggcgctgaaggtgctgctgctggacaaggccaacgtcaagcgggcgggcgccatcgccgagggcatggacagcgtcaacaacgccgtcatcaagggccacgccacgccccagcaatacgtcaaggaaatcaccatcgccaatgacggcatcgtcaaccagaagacgatcatggcctatgcctcccgctcggaagccatgatccgcgagctggattcctggggcgtcaagttcgagaaggacgagatcggcgattacgcggtgaagaaggtccaccacatgggctcctacgtcctgcccatgcccgagggctacgccatcaagaagcacatcttcaagcaaatcaagaagctgggggtcgaggtcagcaaccgcctgaccaccacccggctgctgaccgcgtccgatggccgtatcgccggcgccctggcgctggagtcccgttccggcgagttcgtggtgatccgtgccaaggccgtggtgttgtgcaccggcgcggcggggcgcctgggccttcccgcctcgggctatctgttcggcacctacgagaatccctgcaatgccggcgacggctattccatggcctatcacgccggcgccgaattgtcggggctggagtgcttccagatcaatccgctgatcaaggattataacggcccggcctgcgcctatgtcaccggcccgttcggcggcttcaccgtcaacgccaaaggcgagcgcttcatcaagagcgattactggtcgggccagatgatgctggaattctggcgcgagctggaaagcggcaatggtcccgtcttcctcaagctcgaccatctggccgacgagaccgtcaccaagatcgagaacgtgctgcacattaccgagcgcccgacccgcggcctgttccatcagggccgccacaccgattaccgccatgatctggtggagatgcacatctccgagatcggactgtgcggcggccattccgcctcgggcgtctgggtggacgagaacgcgcggaccacggtgcccggcctctacgccgccggcgatctgtgcaacgtcgcccacaattacatgctgggcgccatggtgttcggcgccatcgctggccaggacgcggtggattacgtggccgggctggaattgccagacctggacgaggcccaggtggcggccgagcgcgaacgggtcttcgcgccgctgctgcgcgaggaggggctggagcccgcccaggtggaatacaagctgcgccgcatggtcaacgactacctgcagccacccaaggtgacccgcaagatggagatcggcctcgtccgcttcgccgagatccgcgaggacctgaagcgcctcaaggccaacacgccccacgagctgatgcgggcgctggagatctacgccatcgtcgattgcgccgaactggccgccctggcctcgctctaccgcgccgaaagccgctggggcctctatcactaccgcaccgatttcgacttcaggaacgacgccgagtggttctgcttcgtcgaggtcaaaaagggtgccgacgggcggccagaactcttcaagcgccccgtcgacccctacatcgtgccggtcggggacgatgagcggaatgcctataacgaattgcgcatcgatacggctgcggagtgacccccatgccccatctcgcccaaccctccgtcaccatcgatcccgacaagtgcatcgccgccaagggctgccgcacctgcatcgacgtctgccccaccgacatcctggcccttggcccggacggcaaggtgcacatggcctatgacgagtgctggtactgcctgccctgtcagcacgattgcccaaccaaggccatcaccgtctccatcccctacctgctgcgctgaggctttcatgcccgatcccgaaatcgccgccctgaccgccgccctggatcagcccgatcctgacatccgccgcatcgcggtgatgcaggcggcggactgggcgcacgatcatcccggcctgttcgcccaagccagccgcgacgacgacgtgggcgtgcggctggaagcggtcaaggccctggatggcgacgcctccgaagacggcgtcaacgccctggccgatcgcctggaggatgccgaggccgaaatccgggcggcggcggccgaatccctggccgaaatcctcgacgaggccgccgggccggcgctgctggcccgactggaaggggcgcggggggaagcaagggcggccatcctggccggtttgcgcaagctgcgccaggagggcgcgctggaaccggccctggacgctctcggcgatcccctggcctcggtccggctggaggcggtccgcgtgctgggctatctgcgccaccaccgcgccgtggcggggctggccgaacgggtggtggtggatggcgatgccgaggtccgccgcgccgccgtgggggccctgggattcgccccgccggacgcggcggcgcccgccctgctgcgcgcccttggcgatgccgattggcagacgcgggaagaggcggcggtcaccctgggcaagctgctgcccgccgaagcggccgatggcttgatcgtcgcccttgaagaccaatactggcaggtgcgccagaaggcggcggtggccctgggccggcttagggcaggcgcggcggtgcctgccctgatcgcccaattgtcccacgtcatcggcaatctgcggcgcgaggccgccggcgccctggccgccatcggcgacccggcggccgtccccgccctgaccgaggccttgaacgatgctgacgtcgaggtgcgcaaatcggcccgccgtgccctggacgcgctggcatgaaaggcttgggggcatgaaggcggtcggcgactttcttcaccgtcgccaggaccttatccgcatggtccaatgggccatggcggcggtgtatttcgtcttgttgctggggccggtcgtaatcccggccagcggtctgggccgggtggctgaggtggtgttctggggaatttggtggccggcggtgatcctgtcggtgatggtgttcggccagttctggtgcggcgtactgtgccccgacggcaccgtcaccgaatgcgccagccggcatggcaagggcgccaagccccccgaagccttgcgctggggctggtggccgctgctggcctttgccgccgtcaccctgttcggcgatgccgccgacgctcatcgctccgcctggggtaccttggcggcggtgggcggcatgtcgctcctcgccctggccaccgggttgtggtttggacgggggcgccgggtgtggtgccgctatctctgcccggcgggcagcgtgttctcgctgctggcgcgggcctcggtcctgcatttcaaggtggatcgcgcccgctgggacgcggcgccgcgaccagcgccaaagccggtggactgcccgttgctgctggatgtacggcggctgaccagcaacgagaagtgcaacatgtgcggccgctgctcgggccatcgcggggcggtggaactggcgtggcggcccctgggctcggagatcgccacgctccgggacgacgaggcgcggccctgggacgcggtgggcatctgcttcgtgctggtgggcctgagcttcgccggatttcattggaccggcgatattgtcgccatcccggccgtggccctggggctgggcggcgccgtcgccgcgtggctgctgctggcggcgggacgacggggatggatgcgtctggcctatgccctgatccccctggccgggttcgggctgttcctgggggcggtcgagcattctctggccctggtggagcgcctggacctgctgccctggctgcggtcggtctttgtcgccctgggcctcgcctggagcggaatgctggggtgggtcctggcgccgggtgtccgcgccaggatcgtcttcaccggcctgtcggcggggctggccgccctctacctgctcatctgaccaaggagactccgcccatggccctgctgatcaccgaccagtgcatcaattgcgacgtctgcgagcaggaatgccccaacgaggccatcacccagggcgaggagatcttcgtgatcgatcccaaccgctgcaccgaatgcgtcggccactacgactacccgcaatgcattgagcattgcccggtggattgcatcatcgtcgatcccgaccgggtggagggcctggacgaattgcaggtcaagtatcgggacttgatggcgctggggagagggggcgccgcatgcccccgcaacaaagaaacgccgcaaacccaataggttggcggcgtttttgattccggggctgggatctggcggatgaggcgggtaagcaaggggtaagcggcatggcgcaagcccccgcatgccggggcatatctaccgctcccgtggtaattccctcatttcctgggggattgccggcggattacccttgagcagcacggttgacttcgatttccttgatcagggcggtgagttcctcgatctgactgccgcgggcggcgcgatcaatctcgatttccttgatcagggcggtgagttcctcgatctgacggccacgggcggcgcgatcaatctcgatttccttgatcagggcggtgagttcctcgatctgactgccgcaggcggcgcgatcaatctcgatttccctgatcagggcggtgagttcctcgatctggaggccgcgggcgacgctatcagcctccctgtcggccaaggccgcggacagtacggcgacattctgggccaggtccgagtcattgtgcagggcggctgcggaattggcttgcagatggtcgccgagtggtcgcccccttccacggacgagagctaaatcatgccagcgcgacgcaagacgttcgcccgatattctgtcgggatccgcttgccctgggctgccaaattcatcgtacagcttcccatacccgagccgtcggagagtatcggcacccagggcgtccgcaatggcctccttgtcggcgtctgagagactttccctccacatatcgatcgacaggtcgtgaactactttttccttgtttattttctggtcgccgagcgcggatggaggcgcgaatgggatcgtcgccatgctgttctcgggaacggcaagggggtcgagccccaggaagtcaaacacttgcggcatcacagtgttgggggcgcgcacaaggtcctcgtagcggatggagtgaacgcggggatcatccgtcgcgacgagatctgcaagcactccaaggccctggacgacatcaaaggctgccggatggtcccgaccctctcggaggatcttggccacatcaatattccaggtgtcatggaatgaggcggcgatggccaggggattgcgcaacagaacaaggaaattggcgctggggaacacacgccgcagaaaggggacgatcaagtgatagcgcggtgtcttgtccacgaagacagacttgccggcccgctggaggtgcccatcataggccgcccgggcggccgctcgggcaacttcgatccgcaaggaatcgtcgaggaattcgtccgtcgcctggccgaccagctggcaatcggccggatggcgacggtcgacgcagccaagctgctcgatggccagcatgatccatggctcgggcggagccatgacctcggggtgattggtcagcagccgggccagcagggttgtccccgagcgtgggatccccaggaggaagaccggatctcgggaggttatcccgctcatcggcttatcaccggcttgccgctgatggtgacgaacccgctccccctggcctccccctggatggtgaaatggtaggcgtcgaggtggcggaccaggaagtcgtgggggtcttcccgcttggaaatgccgcaggacacgaaatagtgcccaggcatcaagcctgctcggatgggccagcgcaacatcacttcgtctccgggatggaacgtggcgtcgtccagcccctcgagaaacgtgttggtcgacacgaccacgtcgccacgaccattgaccatcctgataccgaataccggcccggtcaattccacatggagccgggcctggtagcacagggtgaactcctggtcggaagacgccgatacgatccagccgccggctttgtcttccgcccacaattgcacgatttcagcctgatccgacaggaacagcgccgccgcatcgctgaccgggagtctgacgccgggcggcgtctgcgccggcaccgagatggcctgttcgtgttcggacagagcccctgtggaattggccataatataagcattgacgacctcggacggctcgccttccatccgcacgcggccctggtcaagccaaatgacccggtcgcaaaaccgctccagcgcgttggtgtcgtgtgaaatgatgatggcgctgcgctggtcttgatagataaggtcttccatccggcggatgcatttcagctggaaggcgacgtcacccaccgacagggcctcatcgatgatcaggatgtcggggtcgatgaaggcaaaaatggaaaagcccagcctgaccatcatgccagacgaataggttctgagcggccggtcgatgaactcgcccaggccgctgaactcgatgatatcgtcgacccgtttagccacccattccggcttgacgcccaacatgctggcggccagcgtgatattgtcgcggccgctgacgtcgggattgaagccggttcccagttccagcagggcgtagcagcgcccgttgacctcgacgtcaccggccgaggcctccatcgtgcccgccagaatcttcaggagagtgctcttgcccgagccgttgacgccaacgatccccaggcactcaccctgccgcagggtcaggctgacatcctgcaaagcccagaatttttcatgacgtggcgacctgcccagacggaaccattccttcaggcggtcgccggagttccggtagatcttgaagaattttgaaagattccgaaccgataaggacaccgcctcccggtgggcggaaggccgatccgccgcgctcatagcaggtctctcacgtcacggcccaaccgtcgccaagcaagcgtcgccaatgcgatcaacacgattgtccacaaggcagtcaaggtcagatcatgacgggccggcatccgtccgttaagggtcgcgtcgcgcaacattgccaagaccggtgtcagcgggttgatcatcagaagtttttggaacgattccggcacggcttcaatcgggtatacgatgggcgtcatccacatccacagctgcagaatgatcggaaccgccagtccgacatcccggaaataggtgttcaccagcccgacgatcaggccgaggcaatatgtgtagacccacagaaccaggaagatgatcgggatcagcgcccaagtcagggataccgggttgccggcgaagatcgagagcaggaggaaaatggcgaaattgaccgcgaggaagatgaaggacgtcagcaccacatcggcaacaaacagataggctggcaccggcattttacggatgaactgggcatttcgcaggaatgcgccggcccccagggtcatcgattcgctgaacgcgagccacggaaaatagcccgcgcagaggtacaaggtgtagccaaagggcaagtcgcccttcggcagccgaacgcgcagaatggtctcgaacacggcggagaagacagcgatcgtcaggatgggctgaagggcgttccagagagtcccaagggccgagcccgcatagcgagagccaaagtccgccttggcgcgagcccaaaccaagccgatgaagatcaacgcaggcctggactccatagacggtgctctccgccagacattctgtctccctctcactccgtgccgtatgatccgtgcgcgaagccgggggacagtaatccaaagggcggatggctgcaaggtggaccggacggacccgccccaccatcaacggaagaatgaaacccgggcaccggtcaggcgataaccggccgtattccctttgggggagagggttacggagatgaattcggtgcttccggccgcaccacgggggacggagacggaaacctcgccacccgaaggcgggaccgtcagggttcccaccggcactcctttgaccgtcacgtccaggtcaagggcggcggaatcggccggagccgcctgccaggtcatactcagggtcatgcgatcgaccatgccgcccgggccgacgaaggccagtgcggcctgcggggcggcgatttcgcggaatgtctcatgggggcgccagccctcgacaaaggcggcgtccggtagttgccccccggtcccaggccgggagagcaattcggtcagggctgctgatgtgaagccgaattcacccctgctgggattgtcgcgtgacacattgccgtccgaggtcaccaccaggaccgcatcgaagtcattctccacgaggcggcgcacgacgccatccttagacaggtcggtgatggttgcttccatcttgtcgttgaaagtccgttgtttggcgaaatagtcccagaaaaccacgttggccgggccgagcaggcgtagggcgtgatagacgatctggtcggagtagctgtcgcctatgaccagcagtttccggccctcgcctcccgcggtggaacggcgcttagcggtcacgaacggagtgggcctcaggagtcttgtgggcgccacgatgttcagcacgaccgcgatgtcggtatcaggccccgaggcctggtcaaccttggtttcgctgcaatcgacgcctggccaggggcggccgctcatgccgtccagggtctcgaagaggcgggccgtaaccatgcagccggtccagaacgaccagtggaagccggtggtggcgaagaacggccagggatagcccccccgatcgcgccacagcatttcaaatacattcaatcccagcacgccttgggcggcgagggcattgctgtattggggggggcttcgcgaccagatttccgtggcgggggcatccagccatccgctctccaggtattccggatacaggcgcactttgggcggtggggcgacgaccatcaatacgacgcccttggccgcgagcagcctctgcagcaatttcacgcgctctgccgcctcgcggtaaaccgtggcgacggcagcgccgttgcggagatcatagttcagacggcggatggtatcgacggggtagaatcccatcggctcggcgtaggtgtaaaatctattgggccgtgtcgggaacaggcggagaaacgcctcgttgcgggcggtcagcgcaaatggccgcgccgagctgtcgcgtgccaggaccgccgtgacccagctttgcagcgaaccatccaggaaggaggagatggacaggcccggcatggcgggaggcgcgggcaaatgctccctgattgacggtggccggaacggctggaagaggtattgggcgccgggtagggccatgagggcgatggcgcacagggccagaagacgcggcagccaagtggcgatcttgcggagtggcatcgcgctgacctcagaacctgaagtagaggaagggggagtagttgccgctgaatgcgccggccagtccggccgtcagcagcaggccgccggtggtaaggcgcaccgcggggtgtgcgaggagggccggtggcaaggccggatgccggcgcgacggagccaggcccaacaccaagcccacgaccaagcagacaagtccctgaggctcgaacatcaaccagaagggttgctgcggcgtcgccggcgccggtcccaagccgtacatgcgcgcccacaggctcatggcctgggataacgagtcggcccgaaacaggacccagccgttcaatacgatcagaaaggtggcggcctgccgggcctgcgccggaattgacggcttccagggaaaatgggcggcggccttctctaacgacaggaagaagccgtggaaggcgccccaggcgacgaaggtccaggcggcgccatgccagaagcccgagagcaggaagacgatccacagattggcgaaggtccgcgccagactggcccgattaccgcccagggggacatacaggtattcgtgcatccatcgcgacagcgtcatgtgccagcggcgccagaagtcagtcacgctggttgccgtgtacggtcggttgaagttttccgggaagcgaaagcccatcattctcgccatgccgatggccatatcggaatagccggagaagtcgaaatagatttgaacggtgtaggccagtgctcccaaccaggcatattcccatggcaaatcggcggagggggtctgggcaacggattggaccatcaccgccacctggtcggcaatcaggaccttctttaccagccccatggcgaagcgctggaacccggccaggacgtcgtcggcagagctggatcggtcgatgatttggtcgccgatatcgtggtaccggacgatcggtccggcaatgagctggggaaaaagaaagatatagaggagcgcatccaggaagttccgaggggggggggcgcgccccttgtagaggtcgaccacgaagctgatcttgtggaaggtgatgaacgagatcccgagcggcagggcgatcttgcgccactctcccagcgaccagcccgcctgggccagcagcggcgtcgtctcggccatgaagaaattggcgtatttgaaatacagcagtgcagccacattgatcgtcaccgccagaaccaaggcccgtcggcgctggctggtcgggcgttccggggcgcatccgactttgatcgccagatagtcgattgccgtgccgacgaggacgtagccgataaaaaccggctcgccccaggcaaagaaaaaaatgctgaacgctagtgttgtgatgttcttaattctgacgtttggcgcaacaatatagaatattataaacacaggtaaaaagaacatcagaaatattggtgctgtgaataccattcttgctgccccggtcttatgcgcgcttgtcttttcttgcgtcgatgtgcccgattcgcaaaagccgataaagggcgatgcatgtggtcgggtcctgaatctctgactgatcggccatggccagggccgtatcgaaggggatccaggcaagatctcccaagccaatctcacccgtttccggttccgctttcagggcacaacgggtcgccgcgtaaattgcgatgcgggctcgcagaataccggcctcgggatggtgaaagcccaattcgaccatatcatccggggcgcattccagcccggtttcctccagaagctcgcgggttgctgcggtgcgaatgtcctcgttctcatcggcgaaccctcgtggcacttcccagacccaatcgcgaatcggatggcgaaaggtccgaatcagcccgacctgaccctcgcggatgggcaggattccgacgccggttggggtgctcagcgggtgaatggcgtctcgttcccgatgatcacaggacgtgacggtgaaatattccctgacctcgactccggcttgattccggatccaatccagatagaggcacagtttcgaattctgacggcccagccgcctttccaccaactcaacgctcgccgttttgtcctgatgctttgaattacccgtcatcggccctccaccatcgaatatttccgccgaagatgtccgcggaatatctcctccgacgcgacgcataatggcgcccgactatagtcatcttcggttggagcgcctaggtgtgactgatccggcctccgccgagaatagccggattgaggattgggaggcgcttgaggctcgacgcgcaaggaggccgggaggtggcgggcaaaattcgggcggcgagggaaggtgtctgtgctatcgtcccggccgttggccaatgggggcggaagggccctgtttcataagctggaatcacagatgaacgaagagtggcggacgtatctgagcggggaggcgccgcacctggacgtctctgccgtgatggtcacctatcggacgggtgtttccctgcgtgagagcatcccggcggttctgtcccaatccggcctgaccgagctgatcgtcgttgacaacggtaatgacgacgacacggtcgggtggctggaccggctggcctcgggggatgaccgggtgcggctgatccgtccggttcgcaatgttggctttgccgccggctgcaaccgcggtgccgccgccgcccgagggcagacccttgccttcgtcaacccggatctgatccttcccccggacacgctgttgcggatgggggagatcatgtctacccattccgacgcctggctcttcggggggcgcctcctcaatatggacggtaccgagcaacgggggggaaggcgcgaaattctgagcccttggcgggcgttcgtggaattatcgcgcctcgaccgattgtttccggagcatccctatttccagcgcctgcatcggcacgaagatgaggatgtccacgacgtggtggaggtgccgaccgtatcgggggccttcatgatgatccgcaaacggcattatgagacggtcaatggcatggatgacaacatgttcatccattttgatgacgcggatctatgtattcgcatcggccatgccggcggcagggtcatgtattgcggcagcgtccccatataccactacctgagcacaagcgacgtgccgcgtacctttgtggaatggcacaagacgcgcagcacaagttactatttccataagcacttccgcgcctcgtacccgctatgggctttgactctgacctcggctctgctgtggctgcgtttcgcgctgatcaccgccaaggtgggggtgggcgaccttaagcttctgctgcgcgggctttattccggccgcagaagcaacccgacggcaccggccaccaagaaatagcccaaggggagaaggcgaggggggatgccggcgcgcagcaagatgtggccggaatggtccgtgcctcctacccagggcttctggccacgggcgatgcggcaaagagtgacccgaatggcatccgccagggggatggcgcaccaggccgcgatggtgcccagcccaccgggcttggcgcccagcataacgatcatggcgcccagggttaaactgccgctgtcgcccatgaaggcccgggcgggcgggtagttgaacaacaagaaaccggcgcaggccccggctgcggccaagcccgggtctccattcagccccaggaacgcggctgccgccgtcgccgccgcgacgccgtcggcgtggtccagcagattgagggcgttggccaccagccacagcgcggggccggcccaccagaggccggtcacgccaatggcgaggccggccgcggccaacaggcaaagggccttcacggcgggcgacatcggtcggatgtcatcccaactgccgatggcgcacacaaggccaagcacggccaggtcacccggctcctgccacggggcggtggcgagaagcagggccggaccggccagacgcgggaccgcgccggtctgatgccagcggtcgggtgcgacacgagccacggctcccaggcggtgggccagcttggccagcagccaagtgcctgccgccgccgccggtatggcgatgaggatggggaggaagccggcggctgccaagttacaaccgggagacggtcgtcgggggtagccggggggtgtcgtcggccatgccgcgccagcaatctcggatggcgtcatcgagggaccggtgggggcgccagtccgtggcccccttaatcaatccgatgtcagggattcgcgatgttgcgtgggtaaataacccatcgaacatgtcgtcgtacggcgtctggatgataggagaggcgcttccgacaatatccagaaccagccgggcgagggcgccaatcgtgatgggcgattcgctgccgatattgattgggcgcccggccagggatgcggccgacgtcacagccatcagcgcatcggcggcatcttccacgtgcagaaagctccggagctgcgaaccatcgccgtgaacatcaagggggcggttctgcatggcggcagccacgaaggaggcgaccaccaatcccgtctccgaccgctggcgaatacccgcgatgttgaaggggcggatcagccagacaggcaccccatgttccaggcaaaggccggcgcccatctgctctaacgccatcttggcactggcatagccccagcggggggcgatgtcgagacaggaggggtctgcctcgcgcaagggccgcggcagaccgccgccgtaaatttccgaacttgacgtgagtaccagcgggcgccgatgcgctttacatgctctgacgacggcaattcccgaactcaggatattctcgaccacctcgtaacgggcctggtgcgccagggcgacaccgatggggctggccaagtgataaaccatgtcggcgtccgccaccacggcctcgacctgatcggccgtgtcggtgccaatccgcaggcggtgcagggtaaccccaggatgattgggtaggttttcctcccgtccgccggacaggtcgtcaatcacggaaacggaacatcccaggtccagcaggcgtcggaccagggttgaaccgatgaagccagctccaccagtgacaacgatgttcatcccttgacgcaagcccattgagcgttaccgatccccagtttcctcgtaggcgacagcaattagcacgaatagcttatccaaccaatcagaaggtctggctaacggcggaattgtgaaaagcctccgccagcggtgcccgcatggctatccgcccgtcgcggagcagaagggcctccgagcagaagcgtgacagcagatcgcgtgagcggtcgacgacgatcaggatcgctcctcgccgtaaccgttgctccatttcatccaggacccgctggtgaaataccgggtccaccagttcgaggacttcatcgagcaagatgatgtccgcatccaggcacagggcggaggctataccgagccgagcgaggattcccggcggtgtgatccgggccttggacatcccatggtcgctcacgccggagaactcgaggatgtgacggaccttggcggaagcctcggccagcgtcaggcccatcagcaatccctgcgccagagccaggtcgcccagacttgcttccggatcgacgccaaaacccatgccgaacacggcgccgggcttgccgtctcgaagaatggttcccgattttgggggcagcagaccggccatgacccgcaatagggtggtcttgcccgagctgttcgagccgaggaccgcgatgcggctgccggcctcgatgctcaggctcatgctgtccagcgccgagacggtcatggcgccggagccaccggctcccttcagcagtgatctggtgaacgagcggccctcggcatcgtagagccgataggtgacggtcacgtcctgcagttcaagcctggccatcatcagatccagtatggccagcggggacgtgaccagcggtatagtccgaccgaggctaatcccccggtgagggccatggcaagactgacccaccaattgacggcgggggccacattgccgatggcggcggcgccgacggtggacagcaaatgatggaaggggttgagcagcagcaggtattcaaaccgccccaagaagtaggggggccacaagattggggtcaacaggaaggtgatctgcagcagattggctatcagctgaccgacatcgcgaaatctcgcgcccaaaaccatcgcggcggcccccatccacgccacgttcacgagcaggagcaacagcgatgccgccagcggcaggatggttggcgtaaagccgaggaagagatactgcagcagcaggaatagccccagattgagggcgagaaccggcagatgatgcaagaacacggacagggtgattaccgacagcgaaatgttggagtggcgcaaaatgggcatccaacgggcaaaggcgatggagttctcgccgacgactgccgataggaacgaccagatgaccaggccggcggccagcgagtccacataggtatcgaaacttaccaattgccgccgcaagatcgtgccgaacagcgtccccacggcggccacggccacggcgacgccaatggagttccacagcggccccaggcccgactgcctgaaggcgcgggccagactgaggcggcagagaagcaaggcgagaggccatacacggtaggtggcgatggaggacacttggcagccgatcaaactcgtttggggcgggcgccggagacaaggtttcctgcgtccgaatctgttgctctcggaagtcatggccgcgccatacgcggcacgccgtggctcggtccggcggaggagccgggcatgcggcgagtctgacggccaatcggtgatggggcgcaccagcgacccccacccaatactcctgtgaatcgggagcgtcaatcccgctgaggagggggcttttcggaaggcggaagtggggggggatcacgaatttgcggccttgtaggccgcgcagattgtcttgccttgccgtgcggacgtgggatagtgacgccgttcgcttcgaggggcgcggagcaaggcattaaggaacttgacccattcgggcggcctcgtatgatcgcggagccccaaaaaaggttgagcctgtcccgtcgacaacaatagctttggggcggttttggttgggcctgcgccgcggttccatgaaccctaagcagcagctcagtgaatccttgcgaaggcgacgacacacaacatgttctacgagcttgcggcctcttcatggggtgaggaagaatacgatgccgtgcgtcgggttcttgatcgtggctttttcaccatgggtgataacgtcaaagccttcgagacggagttcgcggcctactttggcaaggcccacgggatcatggtcaattcggggtcgtcggcaaatctggttgctgttgccgccctggcctacaagaggaaccgtcccatccagcgtggcgatgaggtgatcgttcccgccatttcctgggccaccacgtatcatcctttgcagcaatacggcctgaagctgcgcttcgtggacgtggagttggagacgctgaacgtcgatgtaagcaagctggaggcggcattgacgccgcggacccgcatggtcgtggccgtcagtatcctcggcaatccggccgccctcgacgtcatgcgggccttctgcgacaagcacgatctgtatcttctggaagataattgcgagtccatggacgcagagctgggcggcaggaaaaccggcacattcggcgacctcaataccttcagctttttcttttcccaccacatctccaccatggaaggcgggattatcctgaccgatgacgccgaactggcgcatctgtgtcgcagcatgcgtgcgcatggctggacccgtgatattccaaaggacagcccgctgttcgaacacacctccgacgacttttacgaggcctaccgcttcattctgccgggctacaatgttcggccgctggagatggaaggtgcggtcggccgcgaacagctgaagaagctccccgccatgaccgccatgcggcggcggaatcttgccttgtttcagaatcttttcgctgacgacgagcgctttatcatccagcgggaaaacggcaagagctcatcgttttcgttcaccatcatcctcaatccgaagatggatatcgatcgcaagacggtgttctcggcactgggtgcggcggatatcggctatcgcatcatcacgggcggcaatttcctgcgccatgatgtcctgaagtattacgactacgacaccgtcggtgaaatcgtgaatgccaatatcgctcacgactgcggtttctttgtcggcaatcatccctatgacctgagtgcccagattgccaagctgcatcaggttctggacaccgtctgcggctgatcgcctgcaggaaggaaatcgcgcgatgtcctgtcatattcagggggccggtggagccggttgtttgggctccatcatggtcccatcggtacgccagaacatctggttggggcggcccaatcgtcctgggatagggaggactagatgattattagccgtacaccgtttcgcgtgtcccttttcggcggagggtcggattatccgaagtggtaccgtgaacatggcggccaggtgctcggctttgccatcaataagtattgttacctgagcgtgcggccgttgccgccatttttcgagcacaagcatcggatcgtttacgccaagattgagaccgtcaacgagatatcggaaattcagcatccggccgtgcgccacatcctcgatcagatgggagtttccatcggtcttgaaatccaccatgacggtgatctgcccgcccgatcgggcttgggctccagttcatccttcaccgtcggcatgctcaatgcgctgcgggcgcttgagggccggatgtccagcaaggaagagctggcccgccaggccattcatatcgaacagaatgtcatcgccgaggccgtcggctcccaggaccagatatgggcggcctatggcggcctgaatcacatcacctttcaacgcgacgacagtttcgaggtcacgccggtgatcatggacccgcgtcgccagcgcaaattcaccgacaacctgatattgttcttcaccggcttttcgcggttcgcggcggtgatcgccgagaagaagatcgccaacctggatcggaagaccagccacctccgatccatggtcgacatggtggacgaggcgaagtccatcctgacgaacaaggaacgggatctcgacgagatcggcaggctgcttcacgaatcgtggaggcttaagcgggatctggcggatgatgtcagcaccccggccattgatgagatttacgaatctgcgctcgcggcaggggcgctgggcggaaaattgctgggtgccggcgggggcggcttcatgctgttctatgtcgccaaggagcagcaagacagtgtgcgcaaggccttgtcccggctgatcgaggtccagttcgacatcgattattcgggcagcaagattgtggtctatgagcccaaaggccttgaatgcgactgatttcacggtgattggcgaggatgggctggattggcccggacatgcaaggggcctccggtcgatgcggggaggggggatacgcaagtggagttgaatgccgccgcatctcctggaatggatgggggcaacggcgtcggtgggcccctccttgccatccgggaggaagctgacgacctgcggtcacggctggcttctgaccccgcgtgggtctcgctttcctgggctggctgaccggtagatgctgatgaatccgccgccggccgattcgcgcctccgccctaggcggccgttccttcttcccgacgtcgggccgcgccgggtcaagcctccggcttcgatccagcctgctgtcagcgtcctgatcgtcacctacaacagcgccgcccatatccggcagtgccttgaatgcctgcgagagcagacttacgaggatttcgaggtcctcgtggtggactgtgcctcggccgatggatcacatggcgtggcggtcaaggctgcggacggcgacacccgattccattttctgccgcaaggccggaatctggggtttgccgcgggcaataatcttgccgccagggcggcgcgggggcgctggctcgcctgcctcaatccagatgcctttgccgagccggactggttgcagcaactcatggacgcaaccatacgctatccctttgccgacatgttcggttcgacccaattcgacgccgggaatccggctctactcgatggttgtggcgatctctaccacgcagtcggtcttgcctggcgcgctggccacggtggccccatctcgagccttccccgggaccgggaggtcttcagtccctgtgccgccgcttctctctaccgcgcggatggattcaactccctggggggattcgatgaacgcttcttttgtttcatggaggacgttgatctggctttccgctggcgcctgacgggggggcggtgcatccaggtgcgtaatgcggctgtccaccacgtcgggggggcgagcgccggtcggacctccgccttcgcccgctaccacggccttcgcaacgcgctgtggtgtttcgccaagaatatgccgacccctctattggcctgcctgctgctgccgcacttggcgctgctggcggctcttgtcgcccgtgatatccggcgcggccaggggaaggcggccgtgagagcggtgcgcgacggccttctggggctgagggctgtcctggccgatcgggcggtggttcaacgccggcggacccttgcggtcatcgacttgagccggaagtttacctggagtttgcgggcattgtggcgacgggaagcgccttgacaaggctccaaacccgatggcaaattcccgccggctcagaagaagtcatttattttttgacgtgaggacagtgggggctgctcagggccgccaggctgtttccaaacgcatcatgactgactttgatcaagaagtctccgtcatggttcaggagttctaaatggcacaatatttcggaaaactcctctccatgcgcacttcctgggtcgtgataggcatttgttttattgctttgatttatactgtggtcgccgatgtttggggcgtacggttcaccaccttcgacgacgcacgggctgccatttgggcctacgacaacagtgaaatcaacaccatcgccttcggccaggggcggttgtatttcttttatcactcgccctttgtgacgttcggcaactcgttgtggcggaccgtcgctttcgacattgtgcagcacggaggcttcgccctcgcgatcgcgttcgtggttgcgaccttgtcgctgtacatttctctcacgttcgggctgttggcaggcttcatttatctggcgaccctggccgtgacctgggatcacacgctgattaccagcgtgccgctcttccactatgtggtcgtggtcaatatgagcgcgacgctgatggcgctgtacgcctatcgccgcaccggccggtggctctggctgggggcctcgctggcgctctatttccttgccctgtgggggcaggaatatcagataatgatcatcaccgcgctgttcatcgtttgcgcctttgcccggttgcctggtcaggcgccggccggagcagagagcgggccggacaggcgtaagatgatcaggctgtgcggcgcggccatttccctgggggcggcgtatgccgtcgccgtcatcgtctggcggctgatctatggtaaccagtatgatggtgccgagatcagcgcggcgaccttcagcctgaagcactttctgggcgtgctgctgttgtggccgttcggcaccaacattttcgcgtacatcgtccatccgctgcatgttggcgcttcgatggccgggaacggcttcgactatcggctcgacttcgctccggcgacggtcctggccaatctggacggcctgacgccggtgaagatcgcggcggtgctgctggggggggcgctgctgatgcggcacttgcggcgagacgagctgtcgcggggccaattgttgatcctgccgctgctggctggcgtgatcatgctggccccgaccttcctgctggggctcacgcccaagtatcaggggtggtttcagcaggggacccccgcctactcctacagttccatctcggcttatggcgttgctatcctgctggcttggctggccgtcggggttcatggcctggtcgacgggggggcatggcgctggacgattcgcgggggcgttgtcgcggtccttctggtgggggcggtggccgcggattcccagaataatgtggtgggccgtgccatgcgcgaagccacggcacgatggatctccctcaatatggtgttgacctcgccgttgcgcccggagatcgaggacggcacgctgtacgcgccacgtctggctgattattattgggcggtgccggggtatccggattactggcggcgattgctcaagatcgcctacggttccaaaatcgtctacaaggacgcggtggacatcaccgatacgttcggcgacaagtcttattacttcgattatgcctacctgccggaaagccgccgtaatgttgctctgttgagcaaagtcgtgcaggagggcaacgtgccgacgacccggcaggtccgcctgatctcggacggtcctttggataccgctcttgccggcgtgaaaaaggatggtacggcactgcacgtctggttgccgaggatgccggtccagcggatgggcaaggcgttcgtgtatacggtcaatcttcctgaatccactccggttgcctggttgcgggtggagagccagcgcatgtgggcgccgcccaaggctctgaaatcccccatctataagatgtcgagccccatcgacttcagcgaccgcggcaattcccgcgcctttctcggcgacggctggtccacccccgaggcccagctcacctgggccgtggggtcggaaagcgaggtccgcctccttcccagtaagcagagcgggtgtgacgtcaagggaacggtcaaggcgtggccattctacgtcaaggacaagtctcccgatccagaagtgacgatcctggtcaatggcgaccagatgtggaagggctccatctggagggatacggcgatcgacttcaccattccggcggccgtctggaatcgtgatcggttcgtgtccctgaaactgctgcatccctacgcccgttctccgcaggaactgggggtgagcagcgatggccgcaagctggcgctggccgtgcagagcatgaccttccaaggctgcggtgccagtgagggtgcgccctatgaactgggcgacaccatcgacttccgcgacgtcggcaatgccaaaccgtacatgacggaaggctggtccgacccggagcgtgacttgacctgggccatcggtccccaaagtagccttgtgctcggacatgcgaccgtgccggcctgcgacgtggtgatggagatttccgccagtgctcatgccctgccgcccaagctggcccagccgccgctgaccgtggaggtcaacggtaaggttgttggcgacggtaccgggttcgatgctcaggccgccaagcaaagcttcaccatcgaccggatgctgtggctgtccgagcagccagcccgcatccgcttcaaccacccctacgccaaatctcccaaggacctgggcacgagtcaggatccgcgtcccctggctttcgccttccgcagcctttcggtgaaggagcggtgccggagcggtctgcgctagttggttgttccgcgatgcgggctcgtatagcatttcattcggtcgggaggttggtccgtggcggtggggatggctaaaacagcgctggtattcgggatttccggccaggacggggcgtatctggccagccttctgctcgccaagggctatcgggtcatcggcgcgtcgcgtgatgccgaaggctcgagtttcgccaatttgcgggaactgggaatcctggagcagatcagtctgcgttcggcctgcatgaatgactttcatgccattctgaaggtgatctcggagacgcagccggacgaaatctacaatctcagcggtcagagttcggtcggcctgtccttcgagcagcccttgcccaccttcgagagcattgtcggcggaacgctgaacattctggaggcggtgcgtttcctcaacgcctcgatcagattttacaacgcggcatcgggcgagtgcttcggcaacacccagggcgtggcggcctccgagcaggcccccttccgtccccgcagtccctatgcggtcgccaaggccagtgctgccatggctgtcgtgaactatcgcgaagcctatggaatgttcgcgtgttcaggcttcttgtttaatcatgaatctccgttccgcccccaccgcttcgtcacgcgcaaagtggttcgtgccgccgccaggatcgccaggggggaggacttgcggcttatgcttggtgatatctcggttcgccgtgattggggctgggcaccggaatatgtggacgccatgtggcggatgctgaacgtcgatgaaccggaagatattgtcattgccaccgggatccacgcctcgctccaggagttcgttgagaccgtctttggtttctttgatctggactggcgtgcccatgtggacatcgaccccgggctgcgccgtccgagtgatgtggcgatcagctttggtgacccgtcgcgggctctacagcgactgggttggagagcttcattcaccatgccagacgtggcttgtgccatggcgaaagccgaggctggcagcgaaccggcggcggggggagaggttgaaaaatcgctgtgaagggatggcgcttggtgatactttccccaccttacagccgtctcaagtgtagagtggttcttttctagatttttgctgtggcggagttgctgatgtcttcgaaagtggcgctcataacaggagtcacgggccaggatggagcgtatctggcggactttctccttgggaaaggctatgttgtccacggcatcaagcggcgatcctccagctttaacactggtcgtgtcgatcggttctataaggatcggcacgaatccgacgttcgtttcatcctgcattacggtgatatgaccgactcgaccaatctcatccggttgatccaggaggtccagcccgacgagatttacaatcttgcggcccagagccatgtgcatgtgagcttcgagacgccggaatacacggccaatgccgacgcgctgggacccctgcgcattctggaggctcttcgtatcctggggctggtcggaaagacccgcttctaccaggcctccacctcggaactttacggcgcggtgcgcgaaactccgcagacggagaataccccgttctatccccgcagcccctatgcggtggccaagctgtatggctactggatcaccgtcaactatcgcgaggcctacggcatttatgcctgtaatggcatcttgttcaatcacgagagcccgctccgcggtgagaccttcgtgacccgcaagatcacccgagccgtcgccgccatccagaacggcgtccaggacaggctgtttctcggcaatctggatgccaagcgcgactggggccacgcgcgtgattacgtcgagggcatgtggctgatgatgcagcaagacaaggcccaggattacgtgctggctaccggcgagacccggtccgtgcgcaacttcgttgaatgcgctttcgcggaagtggggcgcaccatcgtctgggaaggtcacggccaggaggaacgggggatcgacaaggcgagcggcaaggtccttgtcatggtcgacccgcgctatttccgccccaccgaagtggagcttctgctcggtgacgccacaaaggcgcgccgggaaatgggctgggcaccgaaaaccaccttcgacgaactggttcgcgagatggtggcccacgacctggccaccttcgaggccgatcgtgtcccagcctcccggctctgatgacggcaagcattaatgccaagcttcagcgtcataacgccatcctacaaccagggccaattcatcggccggaccatcgacagtgtgctcggtcagggcgtcgacctggaatattgggttattgacggcggcagcagcgacaacaccgtcgaggtcctcaagtcctatggtgaccggttgcgatgggtgtccgaaaaggaccggggccaggctgatgcggtcaacaagggtatcttgcgcaccaccggcgacgtgatctgctggctgaattccgatgacgtctattaccccggcgcgctgtccaaggtcggggcgttcttcgacgccaggcccgagattgatatcgtctacggcaaggcccaccatatcgggctccatgacgaggtccaggaatcgtattacaccgaggagttcgatttcgagcgcctgaaggacgtctgttttctctgtcagcccgctgtcttttttcgccgctccgtggtcgagcggatcgggttgatcgacgccgaccttaattactgtctggactacgagtattggctgagggctgggcgctcgggttgctccttcgctcacatgcacgactacctcgcgggttcgcgcatgtatgatgacaacaagactctgtcggccagggtccgggtgcacgccgaaatcaacgagatgttccggacgtgcttcggccaagtgccggttggctggctgtccaattacgcgcacgccctggtggactcgagaaatattggtcgcgatgatatgccgcggttcgtcttccatctggcggccgccactttcttcgccagtcttcgatggaatcgcggggtcaatgccgagacgcgcgcccttttgcgccaatggcttcaccattacctgcctcgctggctgaggggggggcgatgaggattggtgtcgacgtcagccagaccggaccgggccgggccgggtgtggcaatgtggcctactatctgacccgagaaatagccgagatggatacgggggatgactttatcctctatcccacattcggcaaccagttctgggatgaccgttggggggagaccttttttccgcctcaagtgaatttcagccgagccctctgcttgaactcccacaccgagtctcgatatttctgggagacgccgccggcagatttacgataccggctgggtcgtcccgatattattcacagccataattttttctgtccgccgcctgttgatggggccaggcttgtctatacgctgtatgacctgtccttccttgagaacccggattggtcaaccgaagccaaccgggaggggtgcttccgcaacgtgttccgggcctccatcgaggccgatcatatcttggcgatatcgggcttctcgcgcgaacacttccttagcctgttccctcattttcccaaggaccgcatctctgtcatgccgctggccagccggtttccggacgacaccccgttggcgcggccgccggaatacgcccatctcggggagtttctgctgacggtggggacgctggagccgcgcaagaactatcgccgcctggtcgaggcctatagccgggttcaccggcagtttgggggtaaaattcctccgttggtgattgccggcaacatgggatggctgatggaggacttccaagccttcctcgcctctctggggattgcagagcacgttatcttcctcggttttgtgagtgacgtccaacttcagtggctgtatcagaacgcctatggcgtcctgtatccttccttgtgggaagggttcggattgcctgtgctggaggcgctcagccaaggggcggcggtgatttcctccgacgtgtcgtccattcccgaaattctgggcgatgcgggtctgatggttgatcccgtcgataccgattccattgccggcggcctcgcggatttcttgcgatccgaggacctgcgggcggccatgcgtgccaaggccaagccccaggcggagcgcttctcgtggcggacttcggcacaaaccgccctggattgctaccgcgaggtggctgcccgcccgccacgcaggcaacccaatggctgatcttcggttttcgatcgcggttcctgttcgtagcggtgtcgattggctggaaaccaatctggacagccttgcgaggcagggagcgggtgtcgccgtcgcccttcttgacgccagcgccgatccgagggttcccgaccttgcccgtcgccattccgacctgatctcctactcgtaccaccgcagttccgacggcggtcaggctgcggccattcgagaaggctgggaggcggtggatggcgatattctgggctggcttaacgccgacgaccatcttcttcccggcgctctggcttctgtccgacgctgcttcgcggcggatccatcggtaggcgtggtttacggtcaggcggcctatgtgtcgggcgacggagcttttctggggtattttcccgcctacgggccggcggaccttcttggtcgggccaatgtgatttgtcagccggccgcctttgtgcgacgcagcgcagtggaccgtgtcggcggtttggactgcgaccggcactacacgatggactgggatttatggcagcgcttgtttcgcgcgggatgccggttccgctccgtcgatagcgttcttgctgtggttgttaatcacgccgggacaaagaccaacagtggatcgccgcgccggacccgggagatcgaagagcttctggcacgcgaggggctatcgccgtggcaacgcctgcgcactcggctgggcattcgcatgggggatcggctgacttccgggcggctgcgggatgggggggctcttggtgcgctgtgggcggccttccggatcctgcggggagggcgcccttccttccgggggctggagcttggcagtaaccgcgtggtcggcggggaggcgaggctggttcttcccgttcccagcggggccgacggcctgatcgtccatgtcgaccggcctcttgatatggtcgttcgaatcgatggtgcgtcaccgctgagcagcgccatgcaccgcatggaagtcgtcaatgcgttcggcgggaacgtcaaaggtatcagtcacgtattttccgtgcctctggcggggcctgcgcacgaactgtgcattaccgcgcccggcccctggaggcttctggcggtgagctgttcaaagggcatgcccccttgcgtctctgggtgatgccagaggcaccgggatcggggggtagggtgagggggtgaaggatgagggaagcaattaaaccgcggggactgcgtatcgccattgataccagatctcttgtcgttggcgtttccggcgggatcatccaaaatcaggtgggggtctttcgggagctgttcaaacgctatcccgagcatacctattttgttttctgcaccccctttaatcgggaaattttccgcgagctgtcggatcatatccacctggtgagtctccccccgtcgtcctatctccacgacttggcgcagacactgcagaccagaaaaatcgatgttctcttccgctcctatccgaccgccgatgcggcggtatttcccatggaacggcagatcatttatatcccggataaccagcacgactactacccgcaattcttttcccgggacgcccgggcttaccgcaagctcgcattcgacaagacgttgcgggaggccggcgccgtcggaacgatttctgaattttcccgttcgacactgcaggcacatcccgaatgcgcctgcagtgacatattcctgatggcgccggcattgcaggaggaacactcgctggcccgggccgaggatctgaccgccgaggaattggctcaggttccagacggtgatttcttcatctatccagccaatctttgggagcataagaatcatcgtagggtgctggaggcattttcccgcctgcttgccgaaacaaatcacaagatttcttttatatttactggaaatcctgcggactggccatcgatttctcggggcttcgaggcgttgcccatttgtcatcttggctatgtccgggcggaattggtccagtacttgcttcagaaggcgcgggcactggtattcttttccctgttcgaaggctttggaattcccctgctggaggcctttcacgcgggtacgccggtgttatgcagcaactgcaccagccttcccgaggtcgccggcgacgcgacgcttctggctgatcccctggatatctccagcatggcggctgccatgaggcagatcctggaaagccccgctctgacggcggaattggtcgagcgtggccgcaggcggctggacgcgttcacctgggcgcagtcggccgacaacctgatggcggcgtttgttcgcgttgcagggcgcaccgttcgctcgcctctggatctccagccgttggtcagcgtcgtgacgccatcctataaccagggccgcttcatccgtcggaccatcgaaagtgttctgaaccagacctatggcaacatcgaataccaggtgatcgatggcggttcggacgacgagaccgtcgacattctgaaaagctatggcggcagattccactgggtctcagagcctgatggagggcaaaccgcagccatcaacaagggcttggcgcaggccaaaggggaaatcctttgttacctgaactccgacgacgtactggagcccgacgcccttgaaaaggtggtcgatttcttcctcaagaatccggaatgcgacctcgtctatggcaaggcccattatatcgacgagaatgacgccgttatcgggagctacaagacctccgatcgccccagtgatctccacacggattgcatcatctgtcagccggcggccttctggcgggccggtctgtccaagctgatcggtcaattcgatgagaccatttccaccgccatggattacgattattggctgagggccgtgaacgcccatgcggtgatcagccatttgcccgaatacatcgccagctctcgcttatacgcggagaccaagaccatggcgcagcgcgagctgatatttcacgaatgcttcgacctctgcgcccgtcacgtcggctatgtccatgcccattatttctttggctattggcattggaagctgatcgagcggcgtccctggatggctcccttcttccgcttctttccactggcatggaaattacccgctagaattagccacgcatacttccttttgcggcgagggttgctgcctcgggcgttcaagggcaagctgcggctgatggcccaacatccgtccgtccgcgggggtatcctccgagtcttgttgcggctgcgcgaacggcttcggcaccgccggctgccgcggggccctcataacggattgacggtttttggggcttggtccgattgctggttggctcccgaggtggagatctgcgggaattggcggagtggcaagaaggccattcgcctcggcggcttcgttccaactgattgcacgatgcggctatcgctgaaccacgccatggtgatagagcggcgcctcgagggaaaccgggagcatatggtcgaattcagcctggatttcgcagaaggcagcaatatcgttacactgagtttcgatgcctggatcagcgataccctccgggacctatctttttgtatctatgagaccaatctcttttgcgaaacagatatcttggttcccgcaaaatgaccaaacctgggcaggtaacgatgaaaaaatcaaatccgtccgtctctgtcgttttttcctttttcaatgaagaggataatattccagagcttcttcggcgctgtcgtcagactcttcgtgccgaacaggaaagcggtaatatttccaagtatgagctgatttttgtcaatgacgattcgacggacgcttccgagcgaatgctgaccgaggaagcccagcgcgagggcgatatcaagcttgtcaacatgtcgcgtaatttcgggaactcatcgtgtattatcgccggattcgagcattcgcggggcgatctcgtgttctacatggacgccgatctgcaggatcctcccgagttgatggcgaagatgctggccgcctggcgtgccgatgacgaggtggaggtggtcaacacggtccgtttgtcgcgggccggcgaatcgaagataaagctggccatcacccgactcggctacgatatcctggccaggacctccagcatcaggttcatccgtgaagccggagacttcaagctgctgtcgcgcaaggtcgtcgaccacatgctggacatgccggaatcgttcccgtttacgcgtgggctggtctactacgtgggcttcaagcaggagaacgtctattatcatcgtgaaagtcggcatgccggtgaatcgaagttcttcgttctcggcccgcgggtcattcacaattttctgttctcggccctgatctcattttcgtcggcaccgcttgttctgtcactgttgatcggtacggtggcggcgctgatcggcgtgagcgtgatgacctattcgatcatccaatatttcgttgtcgacggagtgacgtcgggctggacatcgctgatcgcagccgtgctcttcatggggtcggcgcaattgatcaccacgggaatcaacgggttttacatcaactcgatcttcatcgaaacgaagcggcggccgcgctatatcgtcaagtcgacggtgggggggcctttggatgcgccgaaggccgccgaggctgccgtgccggccaaagatggactgtgattgcgacatgaccgcagacggcctccgtgagcaactgatccaggccccggtccaagtgatcgtcgacttcgttcccgtgatgcccgggggcgagaatggcgaggctcagcaagtggcgttgggcctgttggagggtctgatggcgctccagccgcaatggacgttccacgtcctggtcaactcattggccctggactatgtcggggaattcgccccggcggcaaacgtcatctgtgttcgcgacagcggtggcccggtgcatatcgaactgcccgagttgcccggccgacaggtcggtcatgtcgttttgtgcccctttagcggcccgacctatcatagccgggcgctgccgctggtttcggtcattcacgatctgctgttcgctctctatccgcagtattttctgccggaggaggaaagcgagcggcggcggaatttgcgctatacgagggaattcagcgaccttgcggtctgcgtatcggatcatgtgcgccagaccgtgatcgaggcagcagagtttccggccgagcgggtgcgaaccatcagaacgcggctcgcccctcggctggctccggtccgatcgacggcaattctcgatcatctggggctgcgagcccagggatatctggtgtatcccgccgataccggtctccacaaaaaccacgagatgctgttgacggctcttggcatttaccgctgccgccatccgaaatcggaccttgtgcttgtctgctgcggcgtcggcgacaatgcccgtgccaaggaggtcaaggcggctgcggtgtccatggggctgagtgtgctgtttctcgggcatctgaacggggaagacctgtcggcgctgatttcgaattcgctggcgctgatctttccctctctggtcgaggaatacgggacggcgctgcgggaagccatggccttgggggcgccggtactgtgttcgaacggggccggtctttccgaaatcgtcggggatgccagccttgccttcgacgcccgcaaccccaatgaaatcgctgcggcgatcgagcgctgtgagcaggaccccgccctgcgggaggagctccggcaaaagggactggagtgggtcggggcggccgggagcttggcggacgcggtccgcggatatcgcgatgtcatggtggacgcgatgatcgggcgcggtgtcacggtcgatcgtctgccgcggatttgcgctccggaatggcgggtggggacggtgctggacctgaccctgccggacagccggtctttcctgctcgccggctggtggtcgaccgaggggcatggaatctggctcaaggatgaatgcagcgagatccggttcgaggccgacgatacacgggaggctttggttctgaccatggagatcactccgttcatggtccacggccttccgacggcctatcccctcggcatcgtcttgaatgacaggcccctggcgaccttgacggttgggatgcccggacggatcgtcgttccggtccccgcagaggtgtggaatgcggccaggatcaagaccctttgcctgcgcccgcggggcgggcggacacccgcctcgctgggcgtcaatgccgacactcgccgcttgagtgttgccatccgcacgttggcctttctccatgaacgggcctcgggagtgagcgcggtccctggcgatcccggggcgtctccccctgcttaggctcgggattcattggccagagccggaggatggcggcaaccgttatgctgccgaaaggcgcagaagtttggacgcgcccgccattgttggtgtgatccgccatgagggggaggggcgaggctgcgccggttggctcggcacggcgatggtgtttagaaggtttatgcaagtgtccggcgggctgcgggtcgttgccacaagagtcttggcggtgctgtggaagcctggctcagcgaccctgcaactgatgcgaaaatatcacgctggggagatttggtgacatgttcgtcgccatcggtgttgacataccatcggaccgtgctaaaacgtcgtcaaacctatgggtgacgagggctagggcccatcatattgaggagtgcaggggatgcgatttgatcggagtgcggccctggtggccgttggtgttgtcggtcttgtgtctgttagcccggcgatggctgcgtcggatgccaccagctctgccgcggtcgccaaccaggctgtcgcctctgtggctgctcccgttgctgccgcgcagactgctggtctgatcggcggcgcggtcggcggcgcggtcggcggcgcggtgggtggttcggtcggcggtgccgtcggcggttcggtcggcggcggcagcgtcggtggtccggtcagcaagctgttcaatacccgcgacgccggcaagtccggtggcggcatcccggccaatctcggcatgtgggcgcagggcacctgggtcaacatccgcaagaccgaagcctccctcggcatggacggtaatgtcctcaataccgtgtttggcgtcgactacaagttcaccgaccgcgtcctcgccggcgtggccttcggctacgaaaacgtcgatatcaagaccaagttcaatgctggtacctacaaggccgacggttataccctggccccgtacctgggtgtgagcatcacccccaactggaccgcggatctgtcgggcggctacacttggttgacctacgacgtcagccgcaccagcaacgccgtgaagggtgagttcgacggtggccgtctgttcatcgcttccaacttgaccggttcgtacgccatcgatcgctggcgcctgagcccgaaggttggcgtgatgtacctgaccgagttccagaacgcttacaacgacactggcaccagcaccgctcgcaatgccagccaggttatcgagttcggccgcgccagcggtggcttgaagaccggttatgccttcgacggcttcgtgcccttcgtcaagctgaccggcgagtgggacttcaccaagccgaaggcggtgctcaagagcaacggccagatgtcggccgtcgataatggcggcggtgtcgccggtgtgggtgtcgactttggtggcgcgggcccgtggtccggtgctgtcgaagggtcgtacaactcgatcggtcgtaccagccttgatgtctggcagggcactgccaaggttcgctatcagttctaatcttcggattggtctgaaaatgctgggaagggctaagtcttcgggcttagcccttttcctttgttgtctgctgttgtctggttgcgccagccggttggaaacggccgaagctcttgcggccaaacatcaatggcgaccgagcgtgaccacgaccccctccttcgacctctattcccttggccctggtcggctggtgccgggggctccccttgtcgtttacatcgaaggggacggatacgcctggatcagcaggaacagaatttccgacgatccaaccccccggcgattgctggttctggaattggcattggctgatccacggccaaacgtggtctacctcgccagaccgtgccagtatgtccgcggcagtcaattccggaactgtcagccggcctattgggacaccgctggctatgctccggaggtgattgaggctttcaatgtcgccatcgaccgtttcgcacgcaaagttggtgcctctcaggtgttctatgttggctattccggtggcggcgccgtggcgacgctggtggcggccaggcggtcagataccgcaggcctgattactgtggccggtgtgcttgaccatgaaacctggacaaagctggacgggttaggccccctacgctattccctcaatcccgccgacgagacggcgagggtggtcaatgtgccgcaactgcatttctcgggtgggcgcgaccgggttgttccaagcgccgtggctcgggcctatgccgcccggtatccccgcggacgacgaccggcgatcgaggtgctggacagttacgatcacgaatgctgctgggcggaaggatggcgcgatctgatctcccgacctcttccacgtccaggggagccctgatgcgatctgaccttaattccggcctgcgcccggttctgggcccggccttggctctgctgctggcgctgcccatcgccctggggtcgttgccgccatttcgcttcggatattgggacaaggccgaacccatggtggtttggctcaacctgtgttccttcctgggtgcgcttgccttggcccgttgcgcctgggtgatgccgcgcgccacggtaccgaatctgtttcatccctatgtcctcgcacctctggcggtcgccctttggagtcttgcggcggcgccatttgatgctttgcctcgcctcagcctgttcggcgtaccgcaaagcggacttggcgccctgtggttcctggatttcgccattctcatcgcttgcggcctgatggtgcgggattgccgggttgcctggcggctgttgtgctgggcggcggcggccataacgctggtgattgccggactcaaggtgtccgatcacttttttaccagtatcgagagcactctattgctctatgtggatgcctattatggctggatcggcgtcactctgccggttttggcctggtggtggacacggcaccgtcgcgattggccgttgaccgtgacattggccattgccgcactggcatgcgtctacagctcgcacagcctgacggcctggtccattctgatcggcgggacggccctggtcctggcgtccgaacggctgccggttcagccggttcggcttttcacccgatcgccttgggggagtgcagtcctggttgcggtgggtgcccttttgccgccctttgcattgcgcgctgcaaagccgcttcttaacagtccatctttgctggatcgcctccatcttcaggaaatggtgctggccgacatggcccggtcgccgtcctggctgatggggcagggctgggggcgcgtccaggatgccttccacgggaatctcaatgtcaccggggagaacctttggcagccaacctggatattcctgtccagcgactacttcagcagccataactggctgctggatacggtgcatgccgtggggcttccaggggctggtctggttctggctggatttttggttctgcccctgtatgccgctcctgcggcgcgaccggccgcgaccatgttggctctcgcctatgccctgatctcggcggtctggtttcacctctgcttttccctgccgttctttgccctggccatggcggcggtggggcggtcggcgcgggaggtggagatttccgccctacaaagacgggccgcagcctggagcctgatggccgtcgctgccttaccgatgttgggcgctggggccttggcggaatatggcttgaatatcggggcgattcaccggggtctgacaggtggagctgtttttgaccgggcatggcctgtggacccgcgaggttcggacctggaagcggctgaagtcattcgggacgccttcgcagacctcgccaaagacgagcgtcggcctaatccggcggctattcccggggcgcgcgccatgatggcgacgctggctgcccgtatcccccagagtgatacggtccagatgatcacaattggccttggggttcagtcctatctccatttcagcaaggagctggcctggctggcgccggacttgccaagcagccgcgatttatggcgcccctggcttgatcgtctgttgtggttggcgccggggcgtaccgatcaggcgatcggctatttgacggaccgggccgtggccggtgatctgctggctgtagaacaggttgtcaccgcgattctcaaacggaatcccagtgatccggtcgggttgtattttcgggggctggcgctgattctcttgcgtgatccaacggtccggccgctggcggtcgactcattcagggcttctgtcgccgcggggatcgagcgcttcatgcccctggatccggtggtgcgccaactcatcgagtcccggtgatcagggcaccgtgggggggcgttcggccggcgagccggccagcacctcgtcaacaatccgccgacgctgttccgaggcgccggcattgcccggcggggtaaaacaggcaagcatccggcgtcccaaattctccatgccacgccccagataggtggggggaagcgtcaggtaaaggtcgcaacgccgaccggaggaatcggtcagggttatcccctccggccgttgcgaggtttgcccgagagcccgttcgagacggtcctgggtgtcgggcgagacggggtgcaccgtgatctcgacgctggttcccgacttgcggaccggcggcggacacgaaccggttccaagggtgcaggacaaggtccagcgtgattgcttttccgcggcgtcgatggccgaggaaaggccttcgcgctgggccgccgcctggcgagcggaaagatagcttgatgtctttttcccggtcagcatgtcggggtgaaagccgccggccaggcagtgcaggacttcatggccgaccgcctccagttgaaatgccgagggacccgccggcagagccacgtagatatcgcagcgtcctgagtccgggtctgggacggcgactcccgccagttccatgccggtgtggccgccgaccgcccttctcagggcatccgtctgccgagccgtgtcaagggcatgcagtgtgacgacttgcctggggtgccaccactcgccctgaacgggcatggccgccatctgcgcctccgtcatcgaacagacaggagccttggcgttgacgggagcgccgcaaaaaccacctccgccacagccggagagcagggccgtcgcgacgatgcagaaggcctgcggccaccccgccatggggctaaatggccgaattccacggggcgcgctcgactgggggggcactccatctcctttaacgcttacagtcgcccgatcctctggggaatggtcctacggagcggtttctggacgcgctgattctccgaaatccgctgccatccggctcacatgtcggaaacaacccagatggctgcgaccgagccgccggacgtgcgtgccggcgaagacgcagggcgttcgggtgccgccgcatggagacaccgcagccccgccccgcgggcgggcattggggagggggctctccggcgctgatgacgtcaccgccatcagagaccgggatatggccctctcctcatgcccgcatgcggaccggcgtgaactgcggccaaccgcctttcacctccgagccccgagctaacgtcacgactgaagcgcggctcgggtcggagtggagttgcctatttcttgtcgggagcaggggctgggacggtcttggtgtcggtcatccctcccttggcatcggccgcggcgcccttggcatcggccgcggcgcccttggcggcgtcgctcatcccttgggtggttgctcccgtggtttgcggagtcgtgacagggcgacaacgccaccaggaacctgagcccaggccaccgcgctggagagcaaaagggcggcgcccgcgacagtgatggtcttgatcatggttcgtctcctattctgagatagtccaagtattatcgctcaaggcactgattcggggaaatgaaaacttagcggttgcggaaagggggggcgtccgcgcgtgtacgactttgaccgtatcccggccggcgcagatttccgacgtggaagggcttttctcgacaagcgcggcacggaacggccgatcaggactctttcctgccgggcatcctgtggcataaggggccagccgagccaagggaacccagcctcagatgattcgtttcgaaaatatcagcaagcagaacagccaccgcatcctcttcctcgattcctccgccgccctcaaccggggcgaaaaggtcggtctggtcggtcctaacggcgcgggcaagacgacgctgtttcggatgatcaccggcgaggaagtgccggatgcggggcaggtctccatcgagaagcaggtctccatcggatatttcaaccaggatgtgggtgaaatgtccggccgcagcgcggtggcggaagtgatggacggggctgggccggtcagcacggtggcggcggagctggcggagcttgaggccgccatgtgcgatcccgaccgcgacgacatggatgccgtcatcgagcggtttggcgaagtgcaggcgcgcttcgaggaattgggcggctacgagttggagggccgcgcccgcgaagtgctggcgggcctctccttcagccaggagatgatggacggcgacgtgggcgctctgtcgggtggctggaagatgcgggtggcgcttggccgcattttgctcatgcggccggacgccatgctcctcgacgagcccagcaaccacctggacatcgaaagcctgatctggctggaggatttcctcaagggctatgacggcgccctgctgatgacgtcccacgatcgcgaattcctcaaccggatcgtcggcaagatcatcgagatcgacggtgggtcgctgaccacctattccggcgattacgccttctacgagcgccagcgggcactgaacgaaaagcagcagcaggcccagttcgaacgccagcaggccatgctggccaaggagatcaagttcattgagcgcttcaaggcccgggcctcccacgccgcccaggtgcagagccgggtgaagaagctcgacaagatcgagcgcttcgagccgcccaggcggcgccagaccgtggccttcgactttccgccggctccgcgctcgggcgatgacgtggcggtgttgaagaacgtgcacaagggctatggcagcaaggccatctaccaggggctcgacctcatcatccgccgcaaggaacgctggtgcgtcatgggggtcaatggcgcgggcaagtcgacgctgctgaagctgattgccggcgcggccgaaccggacagcggcaccgtcgccgtgggggccagcgtcaggatgggctatttctcccagcacgccatggaactgctggacggcgacgccaccgtgttcgaagccctggaaagcgccttcccggtggcgaaccaggggtcgttgcgggcgctggccggctgtttcggcttttccggcgacgatgtggaaaagaaatgccgcgtcctatcgggcggcgagaaggctcgcctcgtcatggcgatcatgctgttcaatccgccgaatttcctggtgctcgacgagcccaccaaccacctcgacctcgacaccaaggagatgctgatcaaggcgctggccgcctatgagggcaccatgctgttcgtgtcgcacgaccggcatttcctggcggcgctgtccaaccgggtgctggagctgacgcccgagggcgttcaccagtacagcggcggctatacggaatacgtggcgcgcaccgggcacgaggcgccggggctgcggagttgatccgacgccgagatatttaacgattcggtaaattgctctggaatcgccagccgctagcatgggggcctcgaccgcatccgcccagggatcccatgaagctcgtccgaggccatatcaaacgcctgaccgacctgatcgaggccgaatatcacggccgcgatttcgaccgtcatgaggcctatcgcctagccatgaccttggccgaggcatcgccggagattcgcgacaccatgcggcgcgtcgccagccgcatgacgccttcgggccttcaggcctagggggggcggaatcatgcggttccgccatgtcatcgcgtcgggcctgctcggcctgccctgctgcgccctggccgccgagccggccatccgctcggtggagttcacggccacgcccgctccccgcgtcgccgaggagatggtggtggccgggacccgctcggtggcccgcgtcacctatcaagacggccgccgccgcgattttcccttgagctacgaggtgctgctgcgcacgggagagggcggggccgggctggtggtcgaccgccacggcaaagccattccggccaccttggccgacgagggcggccgggccgccagggggccgttccatgccgcctcgcccgacgccaactcgctgctggtcaccgggacggggccggtgctgatcactcatttcgagtaccagaccgaggcccccgacctggacccggccaagcccccggtcaccatgtatgcccgcctgcccatgtccatggccgccacccggctgggacaggacgccacgtccggccgcctgacggcgcttggcatggacaatgtggacatggcggccatcgagggcctgtggataccctgcgccgggaccctgacgccgtggaacacccatctgggcggcgaggaatacgagcccgatgcccgcagcttccaggccaagccgctggaggccatgaacctgttcctgggcacgcccggcaagaccgccgcccagggcggggccaagccctatcgctacggccatctggtggaagtggccatgtccggcggcagggccgtgccgaccaagcactacgccaccggccgcctgtccttcgaactggccgacattcaggaggacggacgcaccgcctatttcggcgacgacggccgcgatgtcggcctgttcatgttcgtggccgaccgcgtcggcgacctgtcgtcgggaagcctttacgccgccaaatggcggcaggtggacggcgccaatggcggccgcgcccgtctggcctggatccggctggggcatgccagcgatgccgagatcaaggccctggtggatcgcggcatttccttcgacgagattttcgacaccgccgatgcgccggccgagggctttcgcccggtctacgcctatccggggacgggggccaagccccggctggaatatctgcgtccgcgccccggcatggaactggcggcggcgttccttgagacccggcgctatgccgcctggctgggcgccaccaccgagttcaccaagatggaaggccagacccatgacggcgccgggcgccggctgttcaccgccatgtcctatgtggaaggcggcatgctcgatggccgcaacgcagagcggccgcaagacgacatccgcctgaccggggacgagaaggacctgacctgtggcatcgtctaccagagcagcctgtggccgggccagtacgacagcgacgggcggcccatcgccagcgactgggtggcgacggacatgtcggccctggtgctgggggagcgcaatgccgaggggggcggcaaccgccacgacaagtgccataccgacaaggtggccaaccccgacaatctcaagttctcgccggccctgcgcaccttgttcatcggcgaggacagcgggaaccacctgaataattatctctgggcctacaatgtcgacaatggggcgctgacccggctggcctgggcgcccatcggcgccgaatggaccggccttgccgtggtcgagggcttggggcgccacgcctatatcctgtccaacctccagcatcccggcgccgccgaggatctggccaagtatccccccgagatccgcgacgagatgcgcaagcgcgtcgaccagcgcggcgcggtgggctatctgcgggggctgccggccctgcgctgagggcgccgggtcaggccttggcccgtctcttggcgtttcgggcctcgaagaccttgaggaccgtataggtcccccatcccaccaggatcattccggcggtgaaggcgccataggacaggggccagggaacgccctgggtcatcatggagaattccgacattccgccgatgccggccagcacgttgagcggcatgaacaccacgccggccaccgtcagctgcgagacccggcggttctggttgatgttgatgaagcccaccgtcgcatccatcaggaagttgatcttttcgaacaggaacgccgtatgggtgttcagcgattcgatgtcgcggatgatctcgcgggcgtcttccatctgcatggtgttgagcaggcggccgcgcagcaggaatgagacggcgcgctgggtatcgagcatgttgccgcgaatccggccgttgaggtcctcctcctcggcgatgttgcccaggatgcgggcggcgtcggaatcgctgatgttctcgctcaacaccttgcggccgacccggcgcagcgtttcgtaggtgtcttcaagggcgtcggcggaatattcgatgtcggcgccgtaaagggccagcagcaggtccttgcaatcggacacttcgcccggctggctgcgcatgcgcagcctctgcaggcggaacaccggcagctcctcgctgcgcacggtgaacagggtgtcggcatggacgatgaaggccaccggcacgctgcgggactggccgtcgcggtccagcaggaaattggagtggaggtgaagctcgccgttctcctccacatagaagcgggcgctgacctccagatcggtcagatcctcggggtcgggcagttccaggccgaaatgccgcccgagccagccccgttccgacttggaggcgcccagggtatcgatccagatcggccgcagcccttccatctcgctgcgcgacaccacctggatgatccgcatgcggccgtccaccagttcacaggccgtgacctcgccgctgaggaattgcggctcgacattgcccgccagatgctcgcccagcgcgctggagacctcccacagaacatcgttcatgcggtcctgcgccacatggcgccacagcagcctggcgtcgtcgggggaaacgctttccagtgaccggccgatctcgccggccgacagccgggacagcagcatccgcagctcggcggtgtgctggttgtgcaccaccgtctcgaccagttccgggcggcgcgtggcctgggcccgcagcatgtcctcgatgatcttgtgcttgctcagcaattcggtcacggccaacagcgacatcaattctcgcccgaattatggggtggaaagccaaagaccatgcgcaagcggcccggcgaattcaagggtgcgccttcagccgtctgaaagttgtcatggaatggtcaccggcacggtcatcccatgacatcaaatcttcacgagccttcggccaatgcccatcgataatgccacaccccgttggaaaacccgcatggaggcgacgcgtgcttcagaatttctggatcggaaccgatttcgccaagctgctgtcgtcgctgcccgtgtccaatgacggcgtcaaggccatgctggaaagccaggcaaggaatctcgcggcgctggaagaggccaatcagcacgccatcgacgcctttcacgcggtcttcaagcggcagaacgaaattctccatgccgccatccaggaaagcgccaagctggtctcggcccccgaggaggccttttccaaacaggccgagatcgcccggacggccaccgaacacaccctggacaatcttcgccgcatgtcggaaatgctggccgccgcctcggaaaaggccgccgccgtcctgaaccagcgggtgagggagaacatggaggagctcaagaccatctccaggccggaatagccccggcccggggctcgcgggcgatcgcggattgcgcttgaaagcgatatcgcttcgatatacagttacctccataacgcggcgttcgccgctccgccctggaggcaatcatgacccccccgaacaagtccaagaagccggccgcggcgcagcccgacgctgctcccgctcccgctcccgaagtcaccgaggctccccagcccgccgccgcagcggaacccgccgccaagcccgtggtggcgaagaagaaggccggagccaagccagccgcttcgcccaaggccaagaaagccgcgcccaaggccaagaaagccgcgcccaaggcggtgaaggccaagccggccgtggcgccggagccggtcgccgaagaggtcgccgacggcgacaaggtggctaagaaggtgaagaaggacaagaaaaaggacaagaaaaaggataagaagaagaaagaggccgtgatcatccgcttcgatgatcagcagcttccccaggtggatgcccgggccgaagccctgggtctgtcgcgggcggcttgggtccgcatggtggttgcccaggccctggcgaaatcctgattgccgtgcccgctcctgggccgcagcccagggggcgggaatcaccccggaaagttccactccatgaccgacgtcgccgctcctctcccgtcttcccggacccatcttggcgtccaggtccttcttctgggcgaaaggctcgacacccggcgcctggaggaaggcgtggtgctggccaccgcgccgctgatcatccgcgccgggcgggcggggcatgcggtgctgttccgctatggcgtggtggtgctgttcaacctcgaccccatggaggaagcggtcttcctgacctcgctgggcaagctggtcgccgagccgctgccggtgcaggagcgggaatcggccgaggtggtgatcgcccccgacggcgacgaccacctggacaaggaggggcggatctatctgtccgatgcctgtcccgaacgcctgcaactggtggccgaggtgctggcccgcgaactggtcctcgaacattacgagacccgcatcgcccgggtgttcgatgccatcgagcccctggccgcctcgctggcccgcggcaatctgcgccgcctgaagaccaaggacctgctggttcagatcggcgaggtcctgctggccgagcaccggatggtggggcgcgtccaattgctggaaagcccggaagtgctgtggatcaagccggagttggagcgcctgttcgtccgcctggaacgggaatacgacctgaccgcccgggacaaggccctggaccgcaagctggaggtgatctccgacacggcggagaccctgctggacctgatccagacgcgcagcagcatgaaggtcgagtggtatatcgtcgccctgatcgtcctcgaggtgctgctcaccacctacgacatgttcctggccaattagaggccggagcctatccccggcgcgggccgcacagccgggcctggcgttgcgcctgctcttcctcggcggcgcagaagctgcagtgtcgggcgtggggattgacggcgatccgctggggctcgatggggtcatagcaggtcttgcagattcccgaggagcgcggccctgtcatcctgttcagaacggccttcagcgccacgtctctgaaagcttcgattcgttccgccgcgcaatcgatgtcgtccaaggcatgacctccgttcccataggaaagaaaccgcgccaccctgggcaagaacacccgtgacgtgaagtgatcgtttcgtgacaggcccttgatccggccttgcgtcgtgatcggaaacggagagatacttttcccaccttctttcggcacagcggcctttctcgtctctttcggggtggggtccgacattcaaaggaggaatgcgtgctgccgacattttcccttcccccccgttttctgggcgggtgcgcgtcggacccgggcaccgcgacattctgcatcgccggcattcccttcgatcttggcgtgaccaaccgttcgggagcccgcgaggggccgcaggcggtgcgccgcgccagccgcatgctggccgacggcgccaatcccgccggctggagcgatccggcccaaatgtccatcgccgatctgggcgatttttccctggcgctgggcgacatccccaggtcgctggagatgatcgagcagcaggcggcgggcatcggccacctgctggccgtgggcggcgaccacaccatcaccctggccctgctgcgggccctggtcaagcgcaccggcccggtggggctggtgcatttcgacgcccatatcgacacctggcccgataatttcggccagaagctggctcatggctcgccgttctttcatgccttgcgggaagggctggtggatccccggcgcatgatccagatcggcatccgctcgcccatgccgcgcgaggtgtacgactggacggtggggcagggcgtcaccatcgtcaccgccgagcaggtccacgcccaggggccgcaatgggtggccgaagccatcggccgggtggtgggtgaggggctgacctatctcagcttcgacatcgacgccatcgatcccggccaggcgccgggcaccggcacgcccgaggtgggcgggctgttcacctggcaggtgatggccatcctgcgccgtctggcgggactccgcttcgtcggcatggacgtggtcgaggtggcgccggcctatgacgtttccgagatcaccgccctggcggcggcctcgatcctgtggcagtacctgaccctgcggcccctggataaattgtaatatttcaggggcttgtcccggtcctcgggaaggattagattcatcttagtgacgcacacgcacgtgccgatggccctttgtaggttatgcaacgacgaacgcgtcctttttggaggagccggcagaaatgggccggtacccgaaagggaggtggacatgttgacgacccgcggcttgggcgtaatcccccaattcgatcctcagtctcgtttcagtatgtgacgacggtttcggcgttcctctgaccgaacgcccgccatccgcatactgaagggttccgtttcccggccctgtccggggagcgggtggattcatccctgttggggggagttgccgccatgaccgtcgcccgctatcacgcccgcacccgttccctcttcggcagcaccggagctttgccgtcggtgcgcgccgcagtgctggccctgcgccccgaggtgcccatgctgtgcctgcgcccggccaaggccagccgggaggcggcccgcttcgtcgacagcttccccggccaggtgctctatgcggtgaagtgcaatccggacgaggccgtgctgcgcgccctggcggcgggggggatcgggcatttcgatgccgcctccatcgccgaggtcaggctggtgcgccgcctgttccccgaggccggcattcacttcatgcacccggtgaaggcgcgctcggccatccgcgaggcctatggcctgcacggcgtgcgcgacttcgtcctcgacggcgccggggagctggacaagatcgtggcggagaccgagggcgcctcggatctgcggctgatcgtgcgcctggggctggccaagggcgacgcccgcctcgacctgtcgggcaaattcggcgcgtcggcggacgacgccgtccggctgctgcgccgctgcgccgccgtgggccgggtcgggctgtcgttccacgtgggctcgcaatgctgcgatccctcggcctgggagcgcgccctggcccaggccgacgcggtgatccgcgccgccgcaatccaactggacgtgctggatgtgggcggcggcttccccgtcgcctatcccggcatgcggccgccgccgctggcggccttcatggcggccatccggcgcggcgtggcccgcatgggcttgccgtccggctgcgtcctgtggtgcgagcccggacgcgccctggtggccggctgccaatccctggtggtccaggttcaggcgcggcgtggcgacatgctgttcatcaacgacggagtctacggcaccctgtccgatgccggggccctggcttggcgttatccctgccgcctgatcaaggccgccggcgcaagccacgagacgcttcaggccttcggcttcttcgggccgacctgtgattccctcgaccggatgcccggtcccttcctgttgccggccgacacggccgagggcgactggatcgagatcggccagttgggcgcctatggcgcctgcctcaggaccggcttcaacggtttcaatgatctgctgcgcgttgaggtgggcgagcccgctgtcccgtcgcaggccagccgggcggcctgagcccggacgtcacgccaaacaaacaatgtgtggggaggacgagatggaaaactggagccgactgatggacgcgggacgcgaattgtccatggccttcgacctgctggaccgggccgccgagatcaccaccatttccacggcggcggtcctcaccaaggaaggcctgctgggcgccgcccgccaggcggtggcgcggaccaactcgctgctggggcgcaaaccgtggtgaggatcgcaggcgaagtgtaacaccaccggttctttccccccggtatagtgcggggcggttgccacagcctgcgaggggggattgggacatggccgagcttagccataggacggtcagcgtgctgttcgtcagcatcgagggggccgtccgcgcccccatcgccgccgccgccatgaatgcctgccggggcgacgagttccaggcctattgcgccggcacccggccggcggcggagattccggcggcgaccttcgacgcgctgcgcatcgccggcattccggcggcgggcctccgcgtggcgggcctgggcgacttcctgtcgcccgatgccccccgcctggatttcgtgttcaatctcaccgagccctacgagcaatgcggggccatcgccctgcccggggcgccggtcatcgtgtcctggcccattccccatccggtgatggaaagcggctccctggccgagcgcggctcgcgccttgccgagacggtgcggatgatccgccgccgggtcgagctgttcgccgagttgccggccgacaagctggacgccctggccctgcgtctgcgggccgagggcattcaccgccaggccggagcctgacaggctgaggagaaactccgcttcgcggcagggctaccgcccagacccgttcggaggcacagcctcagagccgccagtttctttctatttcaatggattgaaaagatgaaggggccgggaagctgtgcttcccggttgggggatcgggggcaaaagcccccgaaggggcgtcaactggtggcgaagacgggctgcagcccagtctgcgaggccgagagtgatagcggcgccatggaatccgctccctggcggaccagttgcgcttcgagatcggcgggcggcagggggcgcgagaagtagtagccctggaccacgccgcaatcggcatggcgcaggaactcgaactgatgccggttctccaccccttcggcgatcagccccagccccatggcattggccatggcgatgatggcgcggatgatctcggcattgtcggcgttgtgctcgatatccatcacgaaggcgcggtcgatcttcaaggtggtgatgggcaggcgccgcaggtaggacaggctggaatagccgctgccgaaatcgtcgatggcgatgccgaacccccggtcccgcagccggttgagatagccgatcaccttttccggctcgtgcatgaaggtggattcggtgacctcgacctcgatcagatcgggtctgacgccggattggtcgacgatgcggaagatgccgtccacatccttctcgtgcaggaaatggcggggcgagaggttgaccgccacggccacctcgccgaagcctctagcctcccagtccctgatctggcggcaggcttcgttgagaacccattcgccaacggcgacgatcaggtcgctttcctcggccaggggaatgaattcgtcgggctgcaccagcccctcgccggggcggcgccagcggaccagggcctccacgccggccagggcgccgctggccgaggcgatcttgggctggtagtgcagctccagctgattctggggaatggcctggcgcagcgccatctcgatgtccatgcggcgcaaggcccgggcattcatggcctggtcgaagaagtggaaggtgttgcgcccccgtcccttggcctcgaacagggccatgtcggcgttcttgatcaaggtggtgatgtcggcgccgtcctggggatacatgctgatgccgacggagacgccgacccgcagcagattgctgcccagttggaccggcacgccgatggtctcgatcagcttctcggcgacgctggcggcctcgcccgccgagttcaggctttccaccacgatcacgaattcgtcaccgccccagcgggcgacggtgtccatgccgcgcatgatgtcgtgaatccggtcggcgatgatcctgagcagggcatcgccctgcttgtggcccagggtgtcgttgaccaccttgaaattgtcgatgtcggcgaacagcagcgcgatggagcggttctggcggccggccagggcgatggcgtggccgatgcggtcctccagcaggcgccggttgggcaggccggtcagcaggtcccgattggccaattggtgaatgtcctcggttcgctggtcgatctcggtcaggagctggttgtaggcgtggaccacctcgcccagctcgtcgcggctcgaccacaccaggggctcgcgcatcagcaccgaggcattgtggtgcagcgagttgcgcagccgggtcaacggaccggtgaccaggtggcgcaccgccgccagcaggacggcggtcaccaggaggaaggcgccggacagcacgatggccgctccggcccgctgacggaccagttcgctgcgcacctttccgtcgtggaaggccacttccagccggccgacgggatattcgccgcccggcgtctgctggatcaggggcacgaccttgcggaaaacgtcccgccgcccgtcggtgtcgcctccctgcgccgaggcgacgatctcgccgccgatgccgaagaccgtcgcctcgaacagttccgggacatcggggtaggactggaattgccgctgcaccgcggcgaaatcgaattcccacaggggtttgaccagtgcggctccctgggtgatggcaaagctgtccaggcgggagttgagggccgaaagccggtcgcggacgctgtaatgctcgaaggccgagaacatcaccaccgtgccgaacagcagggacggcagaacgatcagcagaagcttgcggccgatggatttcggcgttcgatgggccaagggcatggtcattgtcctcccccgctttccatggcgccggagcggccttccaattgggcgatacggcggttgatatcggccagccgccgctggcgttcgcccggcggcagcgtggtgtcggtctcggtctgcgtccgttgccgggccgcctcgatcagccgcaccgagaccagttgaccatcgtcggaggggacgaagctgctgatgtcgaggcggtccatcgccctgcgctcctcggccagttgcatggcggacttgccggcggccggctggccgtagccgaagaagaacgcggcgatccgctccttgtccgcggcgggcaggtcgcggcgccggaccaggggatcggcgggaatgagtggcgagcgccagacgatccgggtggcggcgagggtgccggggtcgcgtcgcccaagctggtcgtagatcaggctggccacggtggcggcgtcgctacgcccctcggccaccgcgcggatgttgtcctcgtgattggcgtggaccacgcgcttgaacagcttgcggggttccagatgccggctggcgaaaaggtaatagccgggaaccaccgtccccgaggtcgagttgacgtccccttgggcgaaggtcaaatccacggctttggcgatgacctcgtcggcactggccaggggcgaatcccgggggacgatcagataggtgtaatagccgcccaggcccgagggataggtctccttggcgaatacctccgtcccggcaaggtccacggcctcgatggcggtcttgttgcccagccaggccagttgcgcccggccggaccgcagattccagatggccccggcataatcggccgagacctcggccatcaccggccggccaagatgcttgcccagggcggccagcaccggcccccaattggcttccatttcctgccgggattgcggggcgatgagggcgaagcgcagcgcctgcggggcctcggcaccatggacgtgtccggccgtctgaccgatcagcagcgcccaaagcccgattcgcctcgtccacacggcgacggagatccccatggccatccctttcatcgaggaagcagcagcggcatgctgcggcgcaacaatagcgcggggcggcgggccggcgggttaatgttcgattaacctgccggagcgggctcgatgaccaccagcttggagggcgtctccttggcctccttcttgcgcgcggcaatggccgaggccacgtcatccacggtgatgtcggtgcatccgggcggcaggacgaacagtacggcgctggccgacagcagggggaaggacttgacgtgtccctcgcggtcctgggcggtgatgcagcggcgctgccgcgcatcctggtcgtagaagctttcggcgtcggaggcgaagcgtccgatcagctccccgatggccagggcggcctcggcgccgttggtgtgggtgatgccgacgaagaaatcgtcgccgccgatatggcccacgaaccagctctggggatcggcccgcttgcggcacagttcggcgaacagcaggatggcccggtcgccctggcggaagccgtaggtgtcgttgaacggcttgaaattgtcgaaatcgatgtaggccagcaccgccccggccccgccggtaacgcaatcggccacgtattcgttgatgaccacgttgcccggcaacttgcttaagggattctcgtctctggcccgcgccagggtcttttcgtgcatggcacggatcagcgagcgggcgcttaagaaaccgcgatagaccatgtgatcgctgagcaggatgccgtcggtctcctccacggcggcataaagggccagcatctgatccaggggtgtgccgatatcggcaatggggcagcgcacgatgaagtcgcgcacctggcgtcccagcgatttgttggcgatcaggtccttgccgaagctggaataggcgtagttcttggtgtcgcgttcgcgcacgatgccgagcggccgtccggaatggtcgaccaccggggcatagccattgtcggacgaccgggcgaagcgttcgaagatctcgctcatgggggcgtcggccaggatggccggaacctgatccatctgctgcagcacccatttctggtcgatctgccgctggcggcggtcgtcgcgggccagcacctccacatggggatagctggcggcgagacgcagcgggtcaagctggggcgggctgatgaagttgccctgaaccagatccagtcccagttcccggcagaccatcagctcgcggccgttctcgatgccgacggcgatgacctcgacgcccagggtatgggccattccgatgatctgggccaggaccacgcgcttgcgggcgtcgctgtccaggccggcgatcagggtgcggtcgatcttgatgaagtcggggttgcagccggtgagcagcgccagggaatggggcatggctccgaaccggtccaccgccaccatgccgccgccccgccgcatgagcttggcgggataggccgaatcgtcactctcggccggcaggccggcgatttcggtcaccacatgggcgaaggcggtctgcagggcaccctggacgtcgcccagcaatctgtccagatgaccggcggcacgtgcgtccagattgaggaagagggcgccctgggtgagggtggggtagcggggggccatctcgccgatggtggcgcgcacggcgatctccaggtccagcaggtggccggccgcatggcatcggtcgagcaaccaggtggcgctctcctgcgggctgccctcccagccgcgcagcaaggcctcgtgaccgaagcattgcccggtatggacgttcacgatggcctgaaacgccacgtgaaggccgggaaatcgggggttcagttcgatatcatgggacatgacgcggctttgtgatccgcggccgccccaaacggcgaccgcacggcggcatcatgccaaatcggtcatgaacaaacacgcggagcgaggggccgtcagaaaagtttcactattggaatcgccgggctcagccgaaccggccggtgatgtagccctgggtcagggggtgctgcgggctggtgaacatggactcggtctctcccatctcgatcagcttgccgaggtgaaagaagccggtccgctgggacacccgggcggcctgctgcatggaatgggtgacgatgacgatggtgtagctgccgcgcagttcgtcgatcagttcctccaccgcggcggtggcgatggggtccagggcagaacagggctcgtccatcaagataacctcgggggccacggcaatggcgcgggcgatgcacagccgctgctgctgtccgcccgacaggctggtgccggtctcgcccatgcgatccttgacctcgccccacagcccggccttgtcgaggctggagatgacgatctcgtccagttcgtcggcgccggcggccaggccgtgcagccgggggccgaaagcgacgttctcgtagatggatttgggaaaggggttggggcgctggaacaccatgccaacccgggcgcgcaattgcaccacgtccatggccgcgtcctgaatgtcgatgccgtccaggaacagcgagccgctaacccgggcgatttcgaccagatcgttcatccggttgatgcagcgcaggaaggtggacttgccgcaacccgaggggccgatcagggcggtcacctgcccgaccggaatatccaggttcacgtcgaatagagcttgtttttcaccgtaatgaacattcaggtcgcgggcggatatcttgctgctgccaacaaacgaatcaataattgccattacgaacctcgggcggggagggggcgataaaccttcgtcaccgtgctgcaacaatgagcagcatggcgtcactgtggtttatcgctccattcctcgcgtcatcaaacagcttaagtgctgtgaaataaaaaattaaccgaggctctgtggcttgctcgttgtttattggtgaagcctgtatctatttgtaagagctactgcctactccttggcgacgtaggtgtaaaagcggatggacccgtccggttcgatttcgcggtaaagcccctgaatctcggcttcgaagccggggaacaggttggcgctgcgctcgaacatcttgaggtagtcgagcatgggccgggcgcgctcgcacaggcgctcaccggggatgatggtggcgatgccggggggatagaccacccacaaggtggtggcgatgcgcccgtcgatctggtcgatgggcaggtaatccacctgattgcgggtcagcatgcgcaccgcgtcgttggggcgcatcaccatgtgggggcggtgctcgggcgagaactgggcgcgttgcaaggtgctgacgttgcggtcgcggaagaaggcgtgcatctcggcgcacaggtcctggatacgcaggccgcgatagcgctggggccgccgccggacgaattcggggatggcatcgtccagcagggcattgtcgtcgtggcggcgcttgaaggccaccagcgagctgagcagggtgcccgccttgctggattccacgcccggcgtcagcaggaacagcatggaattaaggtcgttcttttccggcaccacccggttttcacgcaggtattgggccaccaccggggcggggatgccgtattcggcataggccccggtgtcgcggttgaagccgggggtgatcagggtcagcttgttggggtcggtcatggcatagcccgaccggctcacatgcttgaagccgtgccagcgggcgccgggggtgaattcccagtagcgcggatcggcggcgatggtctcggtgggcaggtcctcccaggccaccatggtctcgccgccttcgggcgagggcacccggtcgggtacgaaaggctcgaagaaccagtggcgggcactgtccttttccttctcgacgaattcgcgcttgatggcccggaccttcttgcgcagttcgatgccgagatcgatggtgtcgtcccacagcacctcgcccgagcgtccgcgcatcatctgggctcccacgtccagcgacgcgaacagcgggtagaacggcgaggtcgaggcgtgcagcaggaaggtctcgttgaagcggcggtgctcgatgcggcggctttggcccttgatgtggcggtcgcgcacgtggatctgcgacgcctgggagaagccggccatctgcttgtgggtggactgggtcgagatgatgccgggcgaatcctcgtccaggcggtccttcagccccatgccgtagcacccccggaacagcgggtggaacttgaggaagccggcccaggcctcgtcgaacaggatgtagtcgcacaggtggccgatccgttcgagaatgtgctcggcgctgtaaatggtgccgtcataggtgcactgctcgatgaccgccacccggaaggggcggggcttcttccaggcctccgggtccttgaccaggggattgtcgcggatcttggcgcggatggcctgctcgtcgaaggcctcggcgtagatggggccgatcatgcccatggcgttgcggtcggtttccaggaagatgggaatgccgccgcccagcagcagggcgccgtgatgggcggctttgtggttgttgcggtcgaacagcaccaggtcgtcctcggccaccagggccgacagcacgatcttgttggaggccgaggtgccgttcagcacgaaataggttttctcggccccgaagatcttggcggcttccttctgggcctgcagcgccggcccttcatgggtcaagaggtcgcccaactccagcacggaattgtcgagatcgtcgcggaacaccgcctcgcccagatgctcgacgaagatccgcccgatggggctgcggttgtagaagatgccgccgttatggccggggcaggtccacagctggttgccttcctcggcgtaatccaccaaggcgccgaagaacggggtcttcagggtctcggcgaactgcttgaggcggctgaccagattcttggcgatgaattcgggggtttcctcggccaggaagacataaccgtcgatgtaatccagcacatccaccggaatatcctcgaagcgctcgccgcgcaccaggatgacgatgggcatttccaggccgcgccggcgcatcaggttgatcagctcggtggcctcggcccccttgccgcccttttcccagtccaccaggacgcagccgatggcggcgtcggtctgcaccgcgatttccgcgtcctcgatccgccgggcgcgcaccacctcgaagcccaggcgctcgacctcggtgatgatctgctggacgcgcacgccctcaaggtcgtcggtatcgaaggcgggagcgcagaccaggaaggtcaggcggcgaaaaaattccatgggacgctccaataggcttcgagaggcggggtgcgcgatgaggccgcagactaatcagggttggcggcggctgccatggcgcggtcggggggacacaaaacattcatggtcggcatgggaggcgggcgatgccggcctggatttcaatatgcttccccatatggtgtggtcttgctatcctaaagtcgtagtttggccgctgtggtgatcaaccggcaagggggcgctcacaatgcaggaaacggcgacagagcggcatccggatctggccgagaccaaattcgcccgggtgtttgccgtctgcccggacatcatcaccatcaccgcccttgccaccggccgctacctggatgtcaacgacgccttcacccgggtcatgggatatggccgcgatgaggtcatcggccggacttcctccgacatcggtatatgggagacgccccaagaacgccagaggctgctcgaggcgctgagcacttccacccgcctggagaacttcgcggttcgcattcgccgcaaggacggcgaggtggtcgacgccctgctgtcggccgaacgcaccgttctggacggggaggattgcctcatcatcgtcggccgcgacatttccgaccgtatccaggtggaaaaggcgctgagcgacagtgaaacgcgctttcgcctcgccatggaggccagcaacgacggcctgtgggattgggatatccagaccgatcaggcctatttcagccctgcctattttcgcatgctcggctacgagccgggggagttgccggccgccggccggacctggcgggatcttctccatcccgaggaccgccaaggggccgaggccgccgcgtgcgactgcatcgagggacggagcgaaagtttcagcgccgaattccgcctgcgggccaggaatgggggctggaggtgggtgctgtgccgtggccgggcgttcgggcgagaccccgatggccgggcctcgcgcctgatcggcacccatctcgatatcaccgagcacaagaaattcgaagacatcctctcggagaagaaccgggcgctggaacggtccaacgccgatctggagcaattcgcctatgtggcgtctcacgacctgcagacgccgctccgcaacatcgtccgctacgcccagcttctggagcttcgctaccgcagccggatcgacgccgatgccgatgacttcatcggattcatcgtcgacagcggcaagcatatggcacgcctgatcaatgatcttctggaattctcccgcgcttcgcgccaggcggcgcccctggctccgattccggtgggagaggccgtcgcccaggccctgaagaacctggagcttgacctgtccaaggccgggggcgaagtggagatcggcgacatgccggtggtgatggctgatcaggtccatctggtcagcctgtttcagaatttgttgggcaatgccgtcaaataccgcgcgccggaccgcgggctgcggctttcggtcacggccgagcgggcgccgggaggcttctggcgcttcgccgtggccgacaacggcatcggcattgatcccgagtatcacgaaaagatcttcgagatcttccagcggctgaacccggcgtccgacgccgacggcaccggggtgggcctggccctgtgccgccggatcgttcaccgcttcggcggaaccatctggctgcagtccgagcccggccggggaaccacgttcttcttcaccctccgggatggcgctgcagggccgtcctgagcattcccccaacgtccggttgcccatacaaaagaccagatcgccccgattcggctggcaggggcttgcctcgcgccccggatgagccctaaaaataggcactcgcaaaaactcgcctaacaattaggcttgtgcgatggctgttgttgggggggcgccatggccaagggtctcgtatttgccgagaagcggggggcgagcccggagatcgccgcgcggtctccctggattatcctgatcgtcgacgatgatcccgaggtccacgccatcaccaagctggcgctgcgcaacttttcgttcggcggccgcccggtgcatttccttgatgcctattccggcgccgaggccgagcgtgtcctggccgacgagccccagatcgccctggtgctgctcgacgtggtcatggagaccgaggatgccgggctgcggctggtgcagtacatccgcaacatgctccgcaacaagcgtgtccgcatcgtgctgcgcaccggacagccgggacaggcgccggaaaaggacgtgatcgtcgcctacgacatcaacgactacaagcccaagaccgagctgacccaggagcggctgttcaccaccgtggtggcggcgttgcgcgcctatgaggacatcatggcgctggagctgaaccgccgtggcctggaaaagatcctcgacggctcggccatgctgttccagttgcggtcgctgcaactgttctcggccggcgtgctgacccagatgtcggccctggtgggctgccgcgaggatggcctgatctgtgccgtcagggatgacgcccccgagatgagcgccgaccacgtcaccatcctggcggggtcgggcggcttcgaggaccgggcgggctgcaccttgcgcgacctgggcgagccctcggtcatcaccgccatcggaacggcgctgtccgagcggcattcccattatggcgaagaccatctgtgcctgtatctgcacagcccccattaccgccatctggccatctatctggccacctcccaacccattcccgatgtggagcgccagttgatcgaggtgttcggcagcaaggtggcgctgggctacgacaacgtccacctcatcgaggcgctggaagagcgtctgctgcacctcaagcggtccgaggagcgctatgcgctggccgccaagggggccaacgaggcgctgtgggactggagcccccaggtccagaacatctatttcagcccgcgcatggaggagatcctgggggtggcggccggcagcctcaacggctcgccccagacctggcgccagcacgtccatcccgaggaccgcgccctgctccaggccgggctggacgaggcgtgcgagcgtcgcagcgataccctggacctgcagttccgcatgcgccacgtctcgggccagaccctgtgggtgcgcatgcgcggcgcggtcagctacggccctgacggcgcgcccacccggctggtggggtctctgggcgacatcaccgaccgcaagcgctacgagcaggaacgcctgcgctccgccgccgccgaggcggccagcgtcgccaagtcggaattcctggcggtgatgagccacgaaatccgcacccccatgaacgccatcctgggaatgatccggctgctgctggattctcccctggacgagacccagcgcgattatgccgagacggtgctgtcctcgggcgaggtgctgctcagcatcctcaacgacatcctcgacctgtcgcgcatcgaggccggcaagctggagctggagcgcatcgccttcgacctgcccaaggtggtggacagcatcatccatctgatgacgccccgcgccagggagaagtccctggccctgcgcagctggacggcgggcggcgttccggcgcgcctgaccggcgatcccacccgcctgcgtcaggttctgctgaacctgctgtccaacgccatcaagttcaccgaagccggcgaggtgtccctgcacctctcggccgagatccagcccgacggcatcgccgccatccgcatggaggtcaaggatacgggcatcggcatctcgcccgaggcccggtcgcgcctgttcgccaatttcgcccaggccgacgcctccatcacgcggcgcttcggcggcaccgggctggggctggccatctgccagaatctggtgcggctgatgaatggcgagatcggggtggacagcgtgccgggccagggcagcaccttctggttcgtggtgcgtctgccggtggccgtggccctggaggagggagcggccgcgccgccgtcgccggccaagacgctgcgcccgctgaaggtgctgctggccgaggacaatcccgtcaaccagaaggtggcgatcctgatcctcgagcgctcgggccacaaggtcaccggggtcaataacggcgcccaggccctgcgcgccgtgcaggagggcgactacgatatcgtcctgatggacatgcagatgcccgagatggacgggctggaatccacccgccgcatccgcgctctcgaggcgccggtggcccagattcccatcctggctctgaccgccaacgccttggcggccgagttcgagcgctgcatggaggcggggatggacggcttcgtcaccaagccgttccagatcgaactgctggccagcgagatcgcccgcgtcctggcggaaaagacccccggctctgcccgccgcccaccgatggtgccgcgcacgccgctgatcgaccgggcggtgctcgatgatctccaggaccgcttcagccccgatcgggtggcgggcctgctggccgattacgtggtggatgcccgggccaagcgggccgacttcgcccgctgggccgccgccggcgaccgcgcccgggttcaggcggaatcccatggactgaaggaggcctcggccaatttcggcctggcctcgctgcgcaatctggccgaggcggtggaactggcctgtcaggacgaccgctggggggatgcgctgcacctgctggccgaactgcccgagcgcctcaacgagacggtggccgagctgcggcggctgtttcccagcgccgacgccgccatcggcctgcgccagttcgagaccgaggcgggggcacgggcatgatctcgcgcatcagcgtctcggggaagctgctgctgatctatgcgctcgacatggtggcggtgatctttctcggcttctccctggccgaagagaaatacatctccatcaatttcgcccgcaaggaagtggccggcaacgtctatatcgacacggtccgcgacgccctgttcgccatcgccgaggacggtacggtgacggtcgggcaactggccgccctggagcgggcggaggggctttatggtccggagatgtcgagccggatcgcctcggacgacctgctggccagcagccgccccctggccacggcgtcgccccagcggaccgacgcggccgccctgaaggcggtgaccagcgcgcgggccttgatttcgcgcatcggcgatcagtccaacctgattctcgatcccgatctcgattcctattactccatgtccctggtgctgttgcgtttcccggaactggtcgacctgctggcccagatccgcgcccaggcccaccgttcggtgcatgacggggccatcagcgccgacgaccgcaccgagttcctgattctggaagggcgcctgaccaacgtcatcaagggcatcgagggcgaccggctggccggctacagcggcaatcccgacggcagcctggaacgggccctgaagccggccttcgcccttctcgatacggcgctgtccggcctgctggccgatctgcgcgccagcatcatcgaccagtccggccccatccaggccgaaccggtcagccgggccatcgatacctcgctgcaggccaccaaggtcgtctgggtgcagaccagcagcgaactcaaccgcctgctcaacatccgcatcgaaggcttcttccgccgcatgtgggagcatttcggcttggccggcgcgctgttgtcggtgatcctgatcctggtcctgctggtggcccggcgcatcgccgtgcccatcggtcatctggccgaggtcgccgaggcggtgcgccagaccaacgactatgaccggcgggccaagtgggacagcggcgacgagatcggccgtctggtcgacgccttcaacaccatgctggaacggctgcaggccgagggtctgcggcgcgaggagcttgccgcccagacccgcgccgccgaggcccagcgcgatctgctcgaagccattcccaccccgctgaccgtatcgcgcctgtccgaccattcgctgctccacgtcaaccagcccgcctccctgctgctggggctgctcgacagctatgacgccgtcgaggaccatctgtcggcggaggaccgcgagcggctgttccagcagctcagcctgcacggcgccgtcaacgagttcgaagtccaggtcatgggggcgggggacgtgcccttctgggcgctgatgtcggcccgcctgctggtctaccagggcgagaaggcgctgctggccaccatcattcccatttccgagcgcaagcgcatggaagacgagctgctgcgggccaagaacgccgccgaagccgccctgtccgacctgcagcaggcgcagcaaagcctgatccaggcggaaaagatggcgtccctgggcgggctggtggccggcgtggcccacgagatcaacacgccggtggggatcggcctgaccggggcctcgaccctggcgtcggagaccgaacggctgcgcaagctgtacggcgagcaggccatgaccgaggaggatttcctcgattatctgggcgtcgccgccgagaccgcccggctgctgctggccaacatgaaccgggcggccgagctgatccacagcttcaagcaggtggcggtggaccagaccagcgccgagcgccgccgcttcgatctcaagacctatatcgaggaaatcctcaacagcctgacgcccaccatcaagaaacgtcggctgggggtggaggtttcctgtcccgacggtatcgagatgaactcctatcccggcatcctgtcgcaggtgctgaccaatctggtgatgaacgccgtggtccacgcctacgaggagaaccaggccggtatcctgggcatcagggtccaggacctgggcgacgaggtgctgctggccttttccgatgacggcaagggcatctccgccgagaacctgtcgcgcatcttcgacccgttcttcaccacccgccggggcaatggtgggtcggggctggggctgcacatcgtcttcaacgtggtcaccggctcgctgaacggccagatcgacgtggccagcgagccggggcggggcaccaccttcaccctgcgcttccccaagacggtccgttcgcccctgctggaggacatgccggcctgataccaagtcccgttgatcaatagcgatcaccgggacgccctcatgcgccgggcgccgccagtgggcggcttggctcccgcgccataaggcgcacggccacttgggcctggagcaacgggccttaaacctgcgccgtcaatccccctccccccgacaagtcggggggaggagcgtatcagatttagcgctcgcccctcaggccatgtcccgatgaggcggtctcatcgggacatggcctgaggggcctggcggggtcagcccggggtgaccaggcgcttcagctcggtcagcagggtctcgttgtccgccgcgcccttctgcagcaccttctggacgcccccggccagccggtcgcggtcatcctggccgatatccttggcggtgaggaccaccaccggaatcgcgtgccaggcggaatggcggcgaagctcggagacgaattcaaagccatccatctcgggcatcatcaggtccagcaggatcaggtcggggcgggattcggcgacgcgttccagggcgatccgcccattggctgcctcgatcaccgaccagccctccttgaccagcatgcggcgcagcatctcgcggttggtgtggtcgtcctccaccaccaggatgcgttcgatggggccggcttccttgaagcgggacagcacctcggccaattggtcgcggtcgatgggcttggacatgaagtggtgggcgcccagtgcgtagcccagggcctgattctccaccaccgacaccatgatcaccggaatcgccgccagttccgggtcggtcttcagcgcggtcagcaccgaccagccgtccatgcccggcatcatcacgtccagggtgatggccgccggccggagggcgcgcgccatctccaggcccagcggcccgtcggcggcaaagcgcgcccgaaagccgttctcgtccaggaagcggccgagaaggtcgcgggccacggcgtcgtcgtcgatgaccagcaccaggggcagctccgggccggactcgatggcgccggccggtcgtgccgccttggggctggcggaaaccgcgggcaggcgcacggtgaaggtggtgccccgccccggttcgctcgccaccgcgatgtcgccgcccatcatgcggcagaaggtgcggctgatggccaggcccaggccggtgccgccgaacttgcgggtggtggaggcatcggcctgcgagaaggcctggaacaggcggtccagttcggcgggcgccatgccgatgccggtatcggccacggcgaattcgatccactcgccctggcggcgggtggacagggtgatggtaccgtccgaggtgaacttgctggcattgctgagcaggttgaacagcgtctggcgcaccttggtcagatcggcctccatggcgccgatctccccggcgccgtcaaccaccagggtattgccgttcttctggatcagcggcgagatggtggcgaccacgtcggccaccatgggagcgatctcgaacgcctcgacgaacaggtccatcttgcccgcttcgatcttggagatgtccagcacgtcgttgatcagggtcagcaggtggcggccggcggaatggatcttggccagatcgggaatcagatcgtcctggcccaggtcctccatctcttcctgcagcatctcgctgtagccgatgatggcgttcaagggcgtgcgcagttcgtggctcatattggccaggaagctgctcttggcctgattggccgcctcggccgcctgcttggcccggtgggcctcctcctcggcccatttgcgctcggtgatgtccatggccgccgccagggtgccggccagaccgccgtcgccgcccttcaggggcgtgatggacaggctgacgggaaagcgggtgccgtccttgcgccggtaggtccattcccgggccgagatcaggccgtgccggacgtattcggcgaacagggtctccggcgagaccgcatggcccagttcggcggccagctcgtcggcatgggcggcgacctcctcgggcagcaggaagtccagcagggtgctttggcctaccacctcgtcgctggcatagcccagcagggtctcggcgccgcggttgaacagcagcactttgccgttcatgtcggtggcgatgatcgacatctgcagcgccgcgtccagcaccgcctgacgttgggcgttggcgctctggaagcggtcgagcagcctttcggtctcctcgaactgcttgaccaccagccgggcggtgatctcggcggcctcgcgggcgacgcggatctcgccgcgcagcagggcgttctcggcgacaagctcggcgatgcggtcggtcatggcttggatgcctcctcgacggcacgggcggcaagggcggcgacgagcatgtccccggcgggcgcctcgccgcccaccaggatcacctcgggcaccgcgccgtcgcagacccttggcagcaggtggaagaggtagggcaggccggaatcgtggccccaggacccctcggccagggccgccacctcgtgccgcgacagcatcaccacctgacccggcaggccaaagcccgcgacggtatcgacgaacaccgcccgcccggccgtctcgacggtcaagagcaggtccaggccgcacaggccgccatccaccagttcgaccccctggggcagtgccgccccggccagcaggtcgtggacgcgggggccgagatcgtcgtcgggacgatggcggttgccgacgcagatgatgcggcgcgggcggcccatctcaggcctccagacgcacgcggccgaggcttcggcccttgcgtaccgtatggacggaacagaccagacaggggtcgaaggagcggatcacatggccgacctccacgggattgtctgcgtccgccaccggcgtgccgatcagggcttcctcccacggaccgcgcaccccgcccgaatcccggggcgagccgttccacacggtgggcgtgatgatctggtagcgttcgatccgtccgtccttgatggctatccagtgacccagcgcgccccgcgccgcctgaatcatgccgatgccggcgccgtcggggatggggccgggatcggcatagatgtcgtggccgccgctggcgatgacctcgccaagccacaacgccatggcgggcagcagcgtggcgggccgggtcaggcgggccagctcgcgggccagggcattgggcccctgccggcgcagcaggtccgtgaacagcgggtcgcccgccacgatccgctcggcgaaggggccggtctccgccggggtgccgagatagcgggcggccttgacccaggaatagcggcgtccctcctcgcccgaggcatagggctcggtctcgccctcggccgggtggcgcccgccctcgtaggccgcgtaccaggacgccgccacatgctcggcaatggccgctgggtcgaagccctccaccaccgcgccccgggcgaagcccgacgggaccagatggccgccgacgccccgcgccgccgtctccgccggcaggtccagcgagccgcaggacaggaaattgccgtgcccccctcccaggcggtccagcccgatggtccggccgaagcgcagcaggaagcccacgtcgctgtcgcgatgggcggcggattcctccagccagaggtccagcgcctccaggctgtccaccgctcgccagcggtccagggaacaaccgaggatgcgccgctcgtaccacccccggaagccatcgaggacatggcggcactgcagcaactcggccaccggcggggcataggacaggccgcccggtaccatgaacgagctgtggggccactggccgccgatgatggcgatgatctcgaccacatgcttggtctcgcgcaccgcctcggcgacggcctcgccggccagcggggcatagcggcgcaccgcctcgtcatacagcggctgggcgcggtaggcgggattggcgaaatccaccaggaacatcaggatgccctggcgaacgtcgctttggacatgctcggccatcagggcgaggttgcgcagccggacgccgttgtcgggcaccttggccccggccaccgcgtcgagcgccttggccgccgtcatcaggtgggtggtgctgcagatgccgcagatgcggggcgtcaccaccagcccgtccagggcgccccgcccgatcagcaggcgttcgaagccgcggaacatggtgccggcgctccaggcgtcgaccaccatgccgtcggcgatctccaggcgcagttccaggtcgccctcgacccggttgacgggaacatcgagtatcttgcgaacggccatcggttttccccccccctaaatgtcggtgcggcgctggcgcaggcgctcgggcgcggcggcggcggccatgaccttgtagaccatgtaatgggcgcggttgatcccgttggggaggtcaagggggatgccctcgatgttgcgggtctcgaagaaggcgtggtcctgcgggaattccgggctggtacagccgaagcaggggacgccggcccgggtcttggatgagcgctggttccacagaagcttgttgcaggggccggtgaccagggggccgtggcagcccatgtggaagaacaggcagcccttctcgccgaaattgtcttcctcgaccctgtactcgtgatactcgtttctggtgcagccctggtgaaccatcatgccgtaccatggcagcgggcggttcaggggggcgaggggcaactcggcgccggtggccagggcggtcagcacgctggacagcacctgggggtggcagggacagcccgacaggttgaggaccggcaggccggatttcgcgcggaaatcggcgccgaggaacccaccgggctcggaacggtgaaactgcaggccggtggcctcgatctcggtgcgggcgccgaatccgccgaacgcggcgcaggtcccggcggcgaccacgaaacgcgcctgacgcgccagggccgcgacgatatccttcttcggccggcggcccttggtgtcgtacatcccggtgccggccggaccgcgaaggactgcgccctctaccaccaggatgtcgaggggcatctcgccggaagatataacctcaagttgagagtgctgctcggcctgcgaggtgttggagagggatgggtgataaacaacatcgatcccaagtcccgagaataactgcaagatatcgggagtctcagaattcaggaaagacatggtgtcgccaccgcatccgccacattgtaaccagtataaatttaaattcatccccggcctccgtccacccgccacttctttcatcatatatttgttgtatggctcgaagtttatggcgatttggcgcgggtgattgtagttgcaagcaataggccgatcaaatagcttctttgaatatgtacccttccagttgatggggcgccgttgcccgggggcgatcatggccaggattttgttggtcgaggataacgagatgaaccgggacatgttgtcccgccggttgcagcgcaagggctacgaggtggtgatggcggtggatggcggcgaaggcgtcgccatggcggccagcgagaatcccgacctgatcctgatggacatgagcctgccggtgctgaacggatgggacgccacccgccagatcaaggccagccccgccctggcgcgcataccgatcattgccctgaccgcccacgccatggccagcgaccgcgagcaggcgctggcggcgggctgcgatggctacgaaaccaagcccatcgagcttcctcaattgctggagaagatcgagaccctgctgcggcgggcctgagcgtcatggccgtgaccgcattcgaccgccgattggaggccatcgccgagagagtccaggccgtggtgggaccggcggcacggtccatcagggcctctgccgcgactctggccgccgattcctcgacggcggccttcgccgacgagatcggcgagatcgacaatgcggcggctcttctggtggagatggtcgccggctgccggcccgagcttgatgacgatggcagtatcgagaccgcatgctcccgtcttcgtcatgacctgcgcacgcctctggtcgccctcaagggctatggcgagctggtccaggagatcgccgccgaggaagggctcgaggcggtctcggccgcccttggtccgctgctcgaaggcgtcgccgaggtcatggtggccatcgagcgggcgctgcccgccttgtcgcgcgccatggcggcggaggaggccgaggacgacggtcccgacctcgtcacctatcccgccggccgggtcctggtggccgatgacagcaaggccaaccgcgacgttctggtccgctacctgtcgcgcgaaggccatcaggtggtcgccgtggcggacggcctggccgccgtggaagcggtgttcgggcaggccttcgatctggtgctgctggacatgatcatgcccggcatgaatggcgacgaggtgctgaaggccatcaaggccgattcccgcctgcgctcgctgccggtgatcatgatttccgccctggacggcctggacagcatcgtgcgctgcatcgaggcgggggccgaggactacctgcccaaaccgttcaaccgggtgctgctgcgggcgcgcatcggcgcctgcctggagaagaagcgtctgcgcgaggtcgagctgtcctatctccaggcgctggagaaggaactgaccatcgcccgcgaggtgcagcgctcgatcctgcccaaggtctttccgccgcattcctccctggccggacatggcctgatggacccggcccgcgaggtgggcggcgacttctacgacttcttcgccctggacggcgaccgcatcggcatcgccgtcggcgatgtgtcgggcaagggggttccggcggcggtctacatggccatggtgcgcacccagctgcgcgccaccgccctgttcggcctgtcgccggccgagtgcctgggccggctgaacgaccatctcagcgccgacaatcccgaaggcatgttcgtgtcgctgttctacggcatcatggattgcgccaccggcgtcttcacctatgccaatggcggccacaactggccggtcgtgcttcgcgccgaggggggcgtggagtgggtggcgggcaccaacgatctgctggtgggcgtcatgggcggcagcgactaccacgacgcggctcttgccctggcgcccggcgacagcctgttcgtctacaccgacggcgtggtcgaagccatcgacccggccgaggcggagttcggcaagacggggctggtggcggtgctggaggggcttgcccatctggcgccggcggcgctctgcgacggggtgctggcggcagtgcgcgccttcgagggcggccagccccacagcgacgacctgacctgcgtggcggtgcggttcctgggtccggtccgcaattaatcgagacgaagccggaccggcttggctatgttaggggcaaggaatgcaatcgccttcgcttgatcaaagcggaccctcgaagggggatgcctctgtcatgaatatcgctgtcgtccgacaggcgggagccgtcatcgtgacggtgtccggccggctctccagcgccggggccgatcagttccaggagcaactgatggccggcttgcacgacaagcccagagccctgctcgtcgatttctccgaactgaagttcatcaccagcgccggattgcgggcgctgatcatcgccgccaaatggggcagcgccgacggctaccacgtccatctgtgcggcatgagcgagaccatccgcgaagtgttcgaggtcagcggcctgctgcgcatcttcaaggttcatccatcggtcgacgtggggctggcggcgctgtgacgccgccggggctggccgatcgcctcaggcgttgggattgaccgtcttgcaggactttccggccttgcccaggcgcttgcaggcggcacgggcctgatcctcggtaaagccggaaatgcgggcgcgatagagggccttggcgcccttgccggccttgtcgatgtcgatggaggccttggacaccagcccacccagcttcttggccgcgtcgctggccgccttgtgggccggacggtactcgctgaacgcccccacctggatggcccagcccgacgggtcggcatcgcccaccgcgtcgtcgtcgtcgtcgtcgtcatcggcggcgcgggcgggggcacgcaggacgaccttcttggcgggagccggcttggccttggcgacggccttggccggagccttggccggggccttggccgcctgggcggcggcctccaggtcgtccaggtcgggcaggtcgtcgttgccctcggtctcggtctcggcggccgccatctcgacgccgccgccccgccgcagcttggcgaagcccttgtccagcagctggcccatgtggttgtcgcgcgacgaggcggtgctgccgccgaacaccacgccgatgatgcgcttgtcgccgcgcttggccgacgagatgagattgaagcccgaggcgtggatatagccggtcttgatgccgtcggcgccctgatagcgcaacatcagtcggttatgggtgttgatgggctggccgtcatagacgaactgacgggtggaaaaatatttgtaatagccgggatggctgcggatcagggcgcgggccagggtggcctggtcgcgcaccgtggacacctggccggtatcgggcagccccgaggcgttgcggtagaccgtgttgcgcatgcccagcgcatgagccttctgggtcatcatatgggcgaagcgggtctcggtcccgcccacgccttcggccgccaccacggcggcatcgttggccgacttggtgaccagggcgaggatcaggctttccacggaaatcttttcgccgggttcgagccccagcttggacggcgactgggcggcggcatgggccgaggtggtgaacttggaatccagccggatgcgcccggaatccagctcgtcgaacagcaggaacagggtcatcaccttggtcagggatgccggataggatctcgtgtcgggattggccgcatgcaggacggaaccgttttccgcatcgatgacgatggaggcgtagcgtccggcctcggccggctgggccacggcgatgatcgcgacgcccagggcgacggcaatcaggcgaaggcggttcaggaatccggtgcggctcaggtgcaacgtctcgaccttccgttcaacgactgagttggtttagggtatcgcgcaaaccttaaagattttgcgaatcggtgtaaagcgtcgcggacgcccgattcccgccatatttaccggtttatctttccttgccccgacctcctgtcattggatacgccatgctccgccgcctcgcccttccgacgttcgccgccaccctcgccctgctggcgggatgcgcctataccggcgacgacatcggcaacccgctttaccgcaaggcccagtggttctccttcatcgaaggcagcgacatcgctagcgcctgcgccgccggatcggccgagcggttccgcgtggtctataacggcctgtggggccagcaggttcgcgtctatgaatgggatggcgcggccaaggccctgaagatcagcgccatccgcaacggcaacgtggccaccatggacctgtgggacccgctgtcgccctggcgggccgacgtggccagcgtcgccctgagccagggcgcctatgacgggctcgaatcagccctggggcagtccggagcgttcggaccgccggccgagggactgcaattgccgtcccactcctattattggaccgccgcgtcgtgccatcagggccggtacgtcttcaccgcctgggcctatctctccgccgccttcgatgccgccagccttcccgccgccctgatcgcccaggaccccggccgcgacacaatcacgccccccggacccattcccgtcgaccccttccgggaatacgaccgcaagcgcggcgccaccggcgaattcaccctgaaagtcgggccgtcgggtctggcggcctggtagttcgaccgcccccattaaggatatgttgcagcgcaatataccctattgactcgctgctacccggacatcatgatacgcccatgttgcatcgcagcatggggcgatctgtatgccccctgccgccctcgaatcagggaattcagatcatgaccaccaccatcaaggccaagcaggcccccgccaagaccgccgcccccgccgccaaggccgttgccgcccccgccgccaaggccgttgccgcccccgctccggcgaaggcgacccaggcccccgctccggccgccgccaccccgaccgccgcccccatcgccaaggcccacgccgaagcggtcaagaccatcgagcaggcggtcaccgtcggcaaggaaaccatcgaatccgtggtgaaggcttcggccgacgccgccgccaagggctatgatcaggccgccaagggctacgacaaggccgtcgcctccgccaaggagcaggtcgaggtcgccgtggccgcctccaaggaagccgtcgagaccgtggtgaaggcctcgtccgatgccgccgccaagggctacgacaaggccgtcgccatcagcaaggagcaggtcgaggccgccgtgaaggcccagaccgccgcctacaagggctacgaggacgtgctgtcccaggccaaggagaacgtcgaggccttcgtcaaggccggcaccatcctgaccaagggcctgcaggacatcaccaaggctttcgtcggcctgacccaggccagcatcgaggagcaggtcgccgcctccaaggccctgctgggcgtcaagagcctgcaggaattcatcgacctgcagaccgacctcaccaagtcgggcgtggacaagctggtgaccgagtccaccctcctggccgagcagtcggtgaagctggtcgaagagaccctggcgcccatcaacgaccgggtcaccgccaccgtcgacaagctggtcaaggccgccgcctagtccggcaacccttcttgtcaagaggcccggtggtccgtccaccgggccttttttcatgcccgcatcgcccccatgcggaaaaaggggccttttcccaagccatcggctcccaatatgataggggtgtaaattgcaaccaaggtccaagcacacaggcatgagcgagaacgggaacgacaagcgcgacggtgacgacggtcagacgggagtggtcatcaagacccgccccaaaaccaagaagccgtccatgtacaaggtcctgatgctgaacgacgactacactcccatggagttcgtcgttcacgtcctcgaacgctttttcaacaagagccgcgaggatgcgacccgcgtcatgctgcatgttcatacccgcggtgtcgggatttgcggtgtttacacatatgaggtggcggagaccaaggtaacccaggtcatggacctggcgcgccagaaccagcatccgctgcagtgtacgatagaaaaggaatagccagcctcctgccggcattccccttggataaggatcggcccctatgctgtcgcgcaatctggagcagagcctgcaccgtgccttgtctcacgccaccgagcgccgtcacgaatacgcgacgctcgagcacctgctgctggccctcaccgacgatcaggacgccgtggcggtgctgcgggcctgcaacgtcgacgtggacaagctgaagcgggacctgggcgaattcattgacaccaacctgtcggagctggtctcccctcgcgggaccgaccccaagcccaccgccgggttccagcgcgtcgtgcagcgcgccgccattcacgtccagtcctcgggccgcgaagaggtgaccggggccaacgtcatcgtggccctgttctccgagcgggaaagccacgccgtctacttcctgcaaagccaggacatgacccggctcgacgcggtcaattacatcagccacggcgtcgccaaggcgccgggccgcggccagaaccgcaccgtccacggcgccgacgacgaagccaatccggacaaggtggtgaagaagggccaagaggcgctgaacgcctattgcatcaacctcaacaagaaggccgcccagggcaagatcgacccgctgatcggccgtgacgaggagatcgaccgcaccatccagatcctgtgccgccggtccaagaacaacccgctttacgtgggcgatcccggcgtgggcaagaccgccatcgccgaggggctggcccggcgcatcgtcaacggcgaggtgcccgacgtcctcaagaacgccaccatctttgcgctcgacatgggctcgctgctggccggaacccgctatcgcggcgatttcgaggagcgcctgaaggcggtggtcaccgagctggaaaactatgacggcgcggtgatgttcatcgacgagattcacacggtgatcggcgccggcgccacctcgggcggctccatggacgcgtccaacctgctgaagcccgccctggcctcggggtcgctgcgctgcatcggctcgaccacctacaaggaattccgcaatcacttcgagaaggaccgcgccctggtgcggcgcttccagaagatcgacgtcaacgagccgtccatccccgataccatcaagattttgaacggcatcaagacctattacgaaagccatcataaggtgcgctacaccgccgaggccatcaaggcggcggtcgagctgtcggcgaaatacatcaccgaccgcaagctgcccgacaaggccatcgacgtcatcgacgaagtgggcgcgtcgcgcatgctgctgcccgaatccaagcgccgcaagacggtcaccgtccgggacgtggaggagatcgtcgccaagatcgcccgcatccctccgaaaagcgtgtccaccaacgacgtggaggcgctgcgcaacctggaacgggacctgaagaccctggtgttcggccaggacaaggccatcgaggccctggccagcgccatcaagctggcccgcgccgggctgcgcgaaccggaaaagcccatcggctgctacctgttctccggccccaccggtgtcggcaagaccgaggtcgcccggcaattggccaagatcatgggcatcgagctgacccgctttgacatgagcgagtacatggagcgccactcggtgtcacgcctgatcggcgcgccgcccggctatgtgggctttgatcagggcggcctgctcaccgacgccatcgatcagcatccgcacagcgtcctgctgctcgacgagatcgagaaggcccatcccgacctgttcaatatcctgctccaggtcatggatcacggccgcctcaccgaccataacggcaagaccgtcgacttccgcaacgtgatcctgatcatgaccaccaacgcgggcgccgccgacctggccaagtccgccatcggcttcggccgcgagacgcgggaaggcgacgacaccgacgccatcaaccgcatgttcagcccggaattccgcaaccgcctggactcgaccatcgccttcgccaacctgacgccggaaatcgtcgcccaggtggtggacaagttcgtcatgcagttggaaacccagctgggcgaccgcgacgtcaccatcgagctgaccgacgaggctcgcgcctggctggccaagaagggctacgaccgctcgttcggcgcccgccccctggcccgcgtcatccaggagcacatcaagaaggccctggccgaggaattgctgttcggacgcctgtccaagggcggcatcgtccgcgtccgcgtcggcgaggacggcaagctggccttcgagttcctggcctccgcctccaagaccgacaagatccccgaactggtggaatagctcgggatcatcctgccaccgcaaccagggcgctcccaagggagcgcccttttgcttggtccggatgatgggctaattcttgacaatcgacctcggcttggcgataattaacctgtaacagagatggaggcgtaccgggattggaaggttgtcaccgaagtatccgatgcaccaattgcttcacccgaggcatcggttccaccggagaggaggatgttgacagcatgacaccaccgggtcgagtttgaggtgctgacatagtggcaccaggtactagtacaaatcactctcgcgacttatcggcctgtgcgccgaacatcgaggacctgtaggtccccaaaccataagccccgcgcggaacgcaatgtctccggcggggcttcggtttgtctgagccaatgtttagagcaccgcgaaggatctttcagcctgaagcggctggcgtcctcgggttgaattcatgaatacgcacaagagaggtttggaggcatggcctccaagcggggcccatctcaccgagaacaggaggcggcagccccgcgcagccccatcccctcacagcatgcgcacggccatcagcttggcctcggcggcagccagggcgtcgccggcgatggtggcatcggcgatggcgccttccttgagcagggcgaggcggcgggccagacgctcgggctcgggcagctccgccttgtggcacatctcgcccagggtctcgacgatgcggcgcttgtggtcgccggccacccggtgaatgggatcggcgggttcggcgtattccgccgaggccttgacgaagggacagccgcggaacacttccggcgcctcgccgcccagggccgcttcgccccggaaccattcgcccaggacatcgaacatgttcagcacctgggcccgcggcgtcccacccatggcctgcatgcggccgaacagccagtcgcggaaacgaaggtcgcgcaattccagggcggcgacgatcagttcctccttggacttgaagtgatgatacagcgtcatcttggtcagccccgcctcatccagaatggcggcgatgccggtggcgtgaaagccgtcgcgcaaaaacagacgcaacgccgcctcgaccagatcttccctgcgggacgggggagccatgccaacctccattctataccgaccggttacgcatgcatcatagctgccttgacggagaattcgcaacgccgccattgctttgcggcgcgcccctccttatgtgttgccgtcatggacgacagcaagaccaacctcatcggcctgtcacgcgatcagctgatcgccgagatggcctccatcggcgagaaacccttccgggccaagcagctttggcactggatgtacaatcgcggcgaaaccgatttcgccaagatgacctccatctccaaaagcatgcacggcgccctggccgagcgctacgtggtccgccgccccggggtgaccaaggagctgatttccgccgacaccacgcgcaagtggctgttgaagttcgacgacggccacgaggccgagaccgtctacatccccgatgccgacgaggagcgcggcgcggtgtgcatctccacccaggtgggctgtaccctgacctgccgcttctgccacaccggcacccagctgctggtgcgcaacctgtcggcggccgagatcgtcggccagttcatggtggcccgcgattcctatggcgagtggccgactcccgacgatggcgggcgccagttgtccaacatcgtggtcatgggcatgggcgagccgctctataatttcgagaacgtcgccaccgccctggaaatcgccatggacggcgaaggcatcggcatctccaagcgccgcatcacgctgtccacctcgggcgtggttcccatgatgaaggaatgcggcgagcgcctgggcgtcaatctggcggtcagcctgcacgcggtcaccgacgagatccgcgaccgcatcatgcccatcaacaagaagtaccccctgaaggagctgatgcaggcctgccgcgagtatcccggcgcctccaatgcccggcgcatcaccttcgaatacatcatgctgaagggcatcaacgattccgccgccgacgcccgtgccctgctgaagctggtcaaggggctgccggccaagttcaacctgatcccgttcaatccctggccgggatcggagttcgatactcccgacatcaagaccaccaaggccttctcggacatcttgcaggatgcgggctattccgcccccatccgcatgccccggggccgcgacatcctggccgcctgcggccagctgcgctcggaaagccagcgggaaagggcatccctcgccaaggcccgcgccgccgccggcatcgcggacgagcatcacggctgactctccttgccctcgggcgcgctttgcctatactgcgcgcccaattccctcccccatctcggaaaggcgtctgccatgaagggcgaagtcaagaaggtcgttctggcctattccggcggtctcgatacctccatcatcctgcgctggctgcaggaccagtatcagtgcgaagtggtgaccttcaccgccgatctcggccagggcgaggagctggagccggcccgcgccaaggcccgcctgatgggcatcaaggaagagaacatcttcatcgacgacctgcgcgaggaattcgtccgcgacttcgtcttccccatgttccgcgccaacgcgctgtacgagggcgtctacctgctgggcacctccatcgcccggccgctgatctccaagcgccagatcgagatcgccaacatggtcggcgccgatgcggtgtcccacggcgccaccggcaagggcaacgaccaggtgcgcttcgagatgggctattacgccctgaagcccgacatcaaggtcatcgcgccgtggcgtctgtgggacctgaccagccgcaccaagctgctggacttcgccgagaagcaccagattcccatcgccaaggacaagcggggcgaggcgccttattccaccgacgccaacctgctgcacatctcctatgagggcaaggcgctggaagacccgtgggtcgagcccttcgaggacatgtacacccgctcggtggcgcccgagaacgccccggacaagcccacctatatcgagatcgagttcgagaagggcgacgccgtggccatcgacggcgtacgtctgagcccggccgcactgctgaccaagctgaacgagctgggcggcgccaacggtatcggccgcctggatctggtggaaaaccgcttcgtcggcatgaagagccgcggcgtctacgagacccccggcggctcggtgctgatcgtggcgcaccgcgccatggaaagcctgacgctggatcgcggcgagtcccacctcaaggacgagctgatgccccgctatgccgagctgatctacaacggcttctggttcgcgcccgagcgcatcgccatccagaccatgatcgacaaggtcagcgagaacgtcagcggcaccgtgcggctcaagctgttcaagggcgtggcctcggtggtcggccgcaagtcgcccaagtcgctctatcgcatggactacgtcaccttcgaggaagactcggtctatgaccagcgcgacgcccagggcttcatcaagctgaacgccctacgcatgcgcctggccaagatggctcgtggataagtataagcacttataatgcgaaaaatgttggggcttcgccatggcggagccccttccttttagagcatttcatctatccgctttacgtgctccacgggcttttataccattggatagaattacactgatttggtggtaaaagtattgccccctgccgtccgcagcagcccttcagcctctatcgccgtccagaaatggtggccactggttctgtgggggcttgccatggccgtggtggtggcctggacggcggtcacatccgtccgcgatcgcggcgcggccctggccgaggctgagttccgaacccagtccatggccgatctggccgccgagcaggtgctgcgcaccatcgagggcgccgataccgcgctgaaggccgcgcggactcagttccgccacatgggcgactgggacagtctcggcaacgaccgcaagtcctggcagatcattcacgattacggcgaggctctttcggcggtgcccaccgtctacatggccgattccgacggcatgatccgcctgcatggccaaagcttcccgttccgcaaggtctccatcgccgaacgcgattatttcaggctgcaccgggacaaggccgccgacgacgttcagatcagctcgccgctggtcggcctggtcaccggcaatccggtcatcatcgtcagccggcgcctgaccgctcccgatggcggctttgccggcgtggtcggcgccaccattcgggccgatgccttccaggcctttttccagaccctggggctgggcgagggggccatcgtcaacctgcagcgcgccgacgggaccatgctggcccgccagcccttccggaacgacgcggtgggggccaaggtggacaatgcccggtttttccccgccattgccgagggaaagccccatggcgcggcggtcaccgtctcgcccctcgacggcatcacccgcgtcaccgccttccgtcgcatcgaccggtacgggctggtggtcatctccgccatccctgtggacacgatcctcgacggctggcggcggcagaccgtccgcatggcggccatggtgggaatcggcatcgtactgctgtcgaccctgttcatcatgctgctgcgccgctaccacaacgaggtggaggctcgtgccgagctcaagaccagcgaggcgaccctgagtcgggcacaaagcgtggcccatatcggctcctggcaggtggacatcgcctccaaccgggtccgcttttccgaggaaacctaccgaatcttcggaatcacgccaggcgcccccatcagcttcgcctcggtgatggagatgattcatcccgatgaccggcagccggtgcaggatgcgttggccgccctgatgtccggcgggtcctatgacgtggaacaccggatcgtcgccgccggcggcgagctcaaatgcgtggccgccaaggccctgatcaccaatggaaccgatgggcggccacaggagattctgggaaccatccaggatatcaccgagaagaagcaggccgagatcgccatccgcgagcatcaatccctgctgctcgaggtccagagcgtggccaatctgggctattacgattacgacatccgggcggatcgctggcgcagttctcccattctcgacgcgattttcggcatcggccccgactttctgcgtagcggcctcggttggcttcaactggtcgccccgtccatgaaggccgaaatgacgacctatctggcggaaatccaggcgggcgaacacgatttcgacaaggcctacgccattattcgccccggcgacggcgccgagcgctgggtggcggggctgggcaagatcgagcgcgacggcgagggccgccccatccgcatggtcggtaccatcaaggacatcaccaaccagcgccgggccgagcaggcgctgcgcgacaaggccgaggagctggagcgctccaacaccgagctggagcagttcgcctacgtggcctcccacgacctgcgcgaaccgctgcgcatggtctcgtcctatgtggacctgctggcgcggcgctatggcgacaagctggacgacgatgcccgcgagttcatcgccttcgccaaggatggcgcgacgcgcatggaccgcctgatcctcgaattgctggaatattcgcgcatcggccggatcacgcggcccatgttgccggtggccctggggccggtggtggaacgggccttgcgcgccctggctcccaagatcgaggaaagcggagccgaaatcgctacgcctccttccgtcctgcccaccgtcctgggtgatgccgaggaactgatgcggctattccagaacctgatcggcaacgccatcaagtaccgcgaccccgagcgcaagccggtgatcaccctggaagccgagaataccggcaaggaatgggtgctgaccgtggtcgacaacggcatcggcatcgaccccaaatattacgagcgggttttcctcattttccagcgcctgcaccggcgcggcgagttcgagggcaccggcatcggcctcgccgtctgcaagaagatcgtcgagcaccacggcggccgcatctgggtggaatccgtccccggccagggctcgcgcttctccgtcaccctgccgcccatcgggcaggtgtagaccggccatccccgtcgagcactcgcccagtccatccggggcggctgccccgcatgcccctggcctcagccgctccaggccaggacgtcgttggcgtggcccggcgccgtccgccattgcagggcgggcaggacgatgacccgctcgccgctcagctcctcgtagatctcgataacccccatctgctgcatgcgggccagggcggccagggcgcggcggggcgagtggctgccgaaggcctgggtgatcatggaatcgctggggcacggcagggattgggccgccgccgccgccagatgcaggtagatgccctggaactgctcttccaggccggtggcggtgctgaccgccttgtcccatccgggcagggcggcgatggccggcgtcacgcctgcctgggccaggaccagccggcggcggaaatgagtgatgtccagcacccgaccgggcaggcgctgggtgcggcatcgcgccaggaaatcatcgtagaggctcgacaccgagcgcccgagggcgctgctctcgctgaacaactggtcgaggacgccgtcgatgcccgcgcccttgtcgggggcgggcaggggggggacctgcacggggggcggagcgacggaaagaggcggggcctcgccgtcttcggccacggccaggggcgcgggagccggcggcgcctgcggcaccggtgccggggggctgtgctccatggtggccagcagcgcctcggtgcccatgcccatttccggcacatacggcgcggggggcggggtgttggccttgaacagcagccctcttgcctcctccggcgtccgctcgggcagcggcatcagctgggcgccgccggcatggctgcgggtctgcacgtcgccgatgcggatggtgatggagcggcgcgacagggcgggacccaggccgacgaaacgtccgcgctccaggtcgcggaacacctcggcctgtcggcggtcgatgcccagcaggtcggcggcccgctgcatgtcgatgtcgaggaaggtgcgccccatcaggaagttgctggcctcggcggcgacgttcttggccagcttggctaggcgctgggtggcgatgatgccggccaggccgcgtttgcggccacggcacatcaggttggtcatggcctccagcgaggtcttgcgcgcgtcgtcggccacctcgcccgccacggccggggcgaacagctgggcctcgtccaccaccaccagcaccggggtccagtactggcggtcggtgtcgaacaatccgttgagaaaggccccggcgtggcgcatctggcgctctgtgtccaggtgctccaggttaaccaccaccgagacccgcatctgccgcgcccggctggcgatcaggcgcatgccgttctcgctctgggcgccggcgtcgatgacgatatgcccgaacacctgggccagattggcgaagtccccctcgggatcgatcaccacctgctggaccgcctgggcgctctgctcgatcaggcggcgcagcagatgcgacttgccgctgccggaattgccctggaccagcaggcgggtggcaagcaactcctcgagcgacatgagggccggggtgccggaggaagtcgtaccgagatctatatccacgtcttggggaccctgagaaggttggggcgcgatgatagaccatatcggcccggttttcatgccggagatgaccgtcccggcgcgcgtctcccatttgtccgcaatgaagccgggatgagctcagccgggaccgttcttcgaacagggcgggaaagccttctggccatggaccacgccgactcccgccgaaacctcgcagaccgggaaggccctggggggcgaccggccggatcacgcgcgtggcccgagcccggccccaaatgggcgaggtcactttcacatggggggcggtagcctttgctggtcgctggggaattggcccccgtcgtgcggcaatggaggttaccatgtctgcgtttacccttggatttttgatcatcgccacagcctcggcttgggctgcaatcgattaccgccaatggggccggccgatgcttgcggctgtcatcgtcggagccgcgctgatgattggaggctgatgcggccattctttccaaatgtcccacgccaaaatgggcgcacgagtgatcacgggtgaggtcccgtgatcgctggtgtgcttaactgattgatttaaaaccggtggcggaggggagtgggcggaaggcggaatttctctcggtaggggaccgtgtggcgcagaaattcgcatggtaatgttttgtggttttgagtgaaatgctgacctactgcaaccgaagcaacctgtctgcgaaccataaataaaaatcattaacttgaacggtgcggcggctctttggttaattcggttgcaacagcccctcagcctccatcagctgtaaagcctcggcaagagatactcccgcccggaagcacagccactgtccggtatggcggtgccacataagatcgaagcggtcaccgctgacatggtcgaggcgggcaaaggcggaatcaaacacctcacccgcgttgtcggcaaagcccgaacggtaacgctggatgaagctgtacttgtcgccgcgccatttgccggtgatcgcgatggggtagttgaattccgtgggacggatctcgggcagaaaccgggggatcagcacctcggcgatgaaccgctcgcaggtgcgcgaggttgccgccttgtcatccttggtcagccctttgatccatacgccacgctgtcccgccatggtgccctctccttgcctgcacgcgcatcatggcaaagggacagaaattgcgctaccgcaagccgacgcccctccagacgtcagcgactggaggccccatagttcctcgttgatcttggcttacaggggtgctgggatagcgtcatcctacttaagactggacgggagagaccagaggattgagacgtatgcctccccaggtaggaggcgccgatgtcttctgggcgcatcttgaagtctgcgcaatttctgcggcatactaattttgcttggaacgaggtatgccatgagtgatgtacaggaaacggccaaagtgattcccctgcgcccggccaaggccgccaaagcctcggaggctaaatggggaacggcggtgatgaacatgggatttgccatcatcccgtcgttgctcctgcgtgctcagcagcggctggggctgaatcctacgcagttggccgtgctcttgcagctttgcgattactggtgggatgaaaagcgcaagccgtttcccagcaaggaagcgctctctcaacggctgggattgagtacccggcaggtgcagcgccatatcgctgatctggagaaggccgatttggtcaagcgcatcgaacgaattggcagacatggcggcaagctcagcaatacctacgatctctccggtctggtcaagcgcctacaagcgcttgaacctgaatttcgacaagtcgaggaagagaatcgccagcgtcgagaagaggtgggccagcctcgtcatcgaaggcgcatcatcggacgaatcgatcctaccccctgatgattccttggccctaaaaagctcagccccggtcgcatgccagaggcagaggcgggtccggggcttacctcacgacatataggtctcctcccccatgtccgtcaagcctttctccctcgacgataccgtaatccgggcactggcaacgtctctgtccccggagcgcatggctacctatgtcgctgcggccggtggcgaccaggagaaggcgttgcggctctacacctggaatacggcggtcagcgcagcgttctatggccccttgcagggggtggaggtcgccctgcgcaatgccatgcatagggaattgtccgccacttacggtgtcgattggtatgacgatccgcgctgcggcctggatgccggtacgctcagccgaatcgccggcgccaaggatgaactgaggcgggaaaattatgtcgtcgatccgccccatgtagtcgcggcgttgtcgtttggcttctgggtggcgttgctggggcgcggcggccatccgcagggtggtgctggccccaagcggaattacgaaatgaccctgtggcgccccagcctgttccgggcctttcctaacgccaagcttagccgaagccaagtccatagccctctgaattacatgcgcaccctacgaaatcgcatcgcccatcacgagccgattttttcccggcacctcgatgcggattaccagagcattctgtcggttaccggctggatttgcccaagtacccgcgactggatcgcccaccacagccgtgtcgatgatattcttgctcggccacaggatggtgatgatctgcgattttgatagcggacagaggagctattcctcatccacctcctgcgacaaccaggaaactggcaccagcttgatcccgtcacgccaacgctgacgcatcgcccctcggaaccaatcctgtaacaattcgacgtgatccacgacgatgatctgcattggcgtttccgtcgtcgtgcaatagtccaggagcagttggtagagacgtgtgaccgcgatctggtcttcgtcatggacatcgacctctcccacatcccgatctggcgggtaataggcctgggaaggctgatccagcatcaggaaggcggggacaggccgatggcgggcacggaacaacttgtgcagagccaaatgagccgccacatggtaaccgacccaattggccccgctgccgatattgggcagcatcagtggtcccttgatggtatcggccaccacggtgaggcggcgtctgtcgagccgaagcgggttgttgccgtgctccaacgccagggttccggcaatatccgtcagatcgcgtccaacaaaaccaagggccgtggtcaggcgttcctccagcaaatccagatcgagcttcttttcgagagccgcgacctcggcccgcaggcgggcgacttccagtttcaggccgtcgttcgaggtgacggtacgcacattttcgaggtagtagccgatgcgtccggcgatgcgggcctgttcggtaaattggtcctgctcaatgcgaagacgttcgttatcagcgatacgcgccgcgatatcgctctgaactgcccggtggagtccttcgatatccgtgcgcttcgcctccagttcggcgatacggccttgaaggcggggattatcgcggtgtaccgaattcaattgtcgccccaagcccgccaaggaacgcgtgatgtcggttactgacggtaccggggtggcaagatgactttcgcaaagggggcagcgatccggatgatcgccttcgcctgacacaagtccgatcgcgctcaacctgacttgctgctcatgggcttcagccacataatcggaggcttcccgttcaagtcgtttgaggtcgccgatttcgtcccggatgttctgcaactcttcccgcagtctctggcggcgatcttcaagatcggtgaggtcggctgccgggtcgtccatcttggcgtaagcccgctcacgcggagcagcggcggtggcgaggatttcccgcaattgaaccggggtgtcggcgaacacatccggaggaaccagccccacccgcttcgcctctcccagcagtgattccgcagtgacggacgccttgcttgagagtgcctgggcatcattgaattcccgctcccggtcgcgcagacgtgcccgtgcgtccgcatatcgcttctgattgatgtagtggtcgtctcccatggccccgacaaaatagggaagcgtatcgcggatggcggcggtaatgccgtcttccccttgccgatgaaagagcaggcgtgggtcggcgatttcatactgggcctgaaggcagaagaagatggcctggctggccgatgcttccagtgcggggcgctgcgtcgttcgccgatcaggctcgtaaacgttctcggatatgccgagcaagatcgacaggtgatcgcgcaagccatcggcggtcacattcttgtggaaacccttggagctgtcgggcagcacggcgacgttccgttgaaaatagatctcgtcgctggagcggccacctggctccgcgttgggtcgtgcgataaatattccttcgccatcgcggtcaaggaggatggaaaaccacgctacggtgtcgcggattacgccgcctcccgacacgacgaaatcacttctcccccagcaataatcgacaatccgaaggagacttgatttaccggtctgcggcccacccgtaacgatattgaggcagccaaggtcgaacatcacctctcggcgctcatcactgtgggaataaagggcgatagcgcgtaattgcagggtcatggcgtcacgcccatggtttggagaatggtggtgaccgttccctggttagcgaaccagcggccgagtaaccccgcagcccggcgggtcgaagcaacgtcttcggaatctacaggcaatttggccgaaagcttgaggggcgacactccccggctcagtccgtccggcccgagcgccaatgccttgtgctgaacgagaaaaagaagcgcctcccgcgtaaccgcgcgaagagacatcgcccgctccggcaattccgccagcaggacatcatggtcggcggaccatgttgcgaacgtggtattcgccctaccgggtagcgcctggcgggttggcagatgcagaaccagcggaaggatgaggaatgcgaatggcaatggaaatggccgttccgccaagcgttcgtattcctgtgccgcccgcgcaatcaattccccgcagaaggccgggttgagcagcgccgcctcctcggaagggcgattgtgccaaggcagaagggagcgcgcctccgccatttcagccgtcctcatccttgcacaggtcggcgaaatcccggtgccaacccaccttcagctcgttggccagcatgtgataagagccaacattcaggaatcgatgaacctgggcgcgaaacggaaagtgggtatcgctttcaacccattggtaaagatcctgcccggcatgccgaagcgtggtgctatcggtcggctccccagcatgccgttcccgcattctttcgaatcggggctgccattcctcgatcagagtggcctcgaagtgggtgatctcgccgtcgagaaccacatgctcccggacccatttcgatctctgggcaaaggctcggtaaaaatctcgcttggcgaattggatgcgattgccgccgacaccgattgctttcagctgacgaacgaatgggcgcccttcgtactcggcttcgtgggtgtcgggcagatcagcatgctcaaaatcagccaccagcgcgtcccgcttcatctggtcgcggatgtcgtcaagcttggcttccaggtccaggatcgagatcggtgcagacggcttttccatcagtgccgtgcagatgcgtggccaccaccatccttccagcagttcccgggcttgggcagccttgccgcgaggggcaataatgcggagaggaccgtcctcaatgacttggttcagatcggcaagggttgcgtgaccgtcaagcacctcgacggcactgagcagggcgatccgcattgtcggcgtcaaagccaggaaggctgagtaggccggcaggagcgcggcgttcctcccgccttcggcaactttggtcagggtatcggcggctccgacaggatcgcgtgtacaaaggtggagcgaccgcagcttagcggcggcctgtccctctggcgtcaccccggtggtcaccaggacgaaacatgtccgctgcgggagagagggatcgacctgtgtcgcctctgaccagatgcgcaatgtcttccagagatcaacactgtagtcggacaggcttgccgcccgatccaaatggtgcttggtctggaggagttcgagcggggttccgttgatctcgaacgagatgtcgtcaagccgttcgattccaacctcgacgggagttcccgaattggcgtgtctcaaacacaacgcgagagcgagccgggcctgataaagatagcccgccgctgatcctgccgcgctaaagtcagtgccgtcagccatcagtcgccccctgctgtgcgattgatggtgtagtatttgtgcaattcaggcaacaagaagatgtctcggcacttgaaggggaaattccctcagcaggagcagtgggggagtgcgcacagtcagtccttgagcaactcgttcaaatgtccttgccttgtttccatggtggcggatcgtatcgagtcacggcaaacatgccccaatcatagcaagttcagcgcccattggatgccgtctccagctccagccgtgcgactgcggcatcgacctgtgagcgcaggctatttttctgatcggcgggggcgctcttgaagcggcgcagcagatcctcaacctcgatcagagtggaggtggcattggccgatggactggttcccaggcggacgcgcatggtctcaatctcagccgatttcgcggcagcccaggcgctgtcgggggaactcgtgtttttctcggcggccagaaccgtcccggagatgagggccgccagcactgcggcgatatggagatatttcatggatcaccttcctggcattagggtctttggtggccgcccctcctcggccggatgggattcgtggtggatgatccaattgccgcaagcggtctggatcatcagcgacgtagagaggcatgtttcctcaaactgaggcgctttcaaccagcttgccggggaaaacgatgttcggcacgataaatcgccggtttcaactggttgatgttggcccatctaaccccctttggaatggggtgataagccacttaaggtgcaaaatcacgacaccttcctcggcgggtatatccaccagcatggtcgatgtttgcatgtgttcttcgccttccggttctgcgtagatttgggcgcagtctatttttggcgtatacaggcatttgtgctacagtggcgcgcgatcggtaaatacaaagcttgaatataaggcatgactaaatgctgatcgctaacagagatgctttttatcctaagtgtaggtgggttggacaatatgtcgattgtcgaacattgggttgataccccagaggtggggtgtagaacggtggtccgtcggcacccggagacgttcgcccaccatgcgttgggggacggcgcagatttcttttatgtatgttcggaaggagtgccggacatcaattataagaaagtcgtgatgccccatgatgcccagctgtggattcgggtgtttctcgcggggggcgacgaatgtctccggccaggaatcagcgcccccattgtgactgatgaggagcggttcagcgtcggcatctgccgccacccggcatcattctatcgagccctgccgggagggggcagcttcgagcatgtcgctttggcgctgaccccggatcggttacgtgattatttcggtgatacgcgttgcccacttcccttggccagaatgcttgatgatcgtcccgagacgctggccctcactccgactcgaaccgcacatatggggcgcatcgtgcacgatgttcgcggcgccccttatcgcggtaaagccctggatttcttccttcagggcaaggttctggaaatgttgtcggcggtggttgacgtcctggaccaggggggcggcggagatgaacgggttcttggccgagagcggcgacggcttttggacgtgcgtgacctgctgctggccaatctgacctctccgccagatctggtcacggtggcgcatcaggttggttcgtcgccccgccggttgaacgaagcgttccgcagtgaattcggcatgaccgtacaacagtggcttctggaccagaagatggccttggccgcccggttgctgattgtgggggaattgtccatcaaggaaatcgcctacaggctgggatatgccaaccgcagcgctttcacggcggccttttctcagcatttcggcgctcccccagccggattccgtgacgggcaggcgatgcctcatcgcgcatcaggcacgccctcctaacactttaggcaagattccgtacaccacctcggttcaatttggaccgctctttgcgttttaattccgtggtcgaaagtatcgacgcggagagcgcatgtccgatgatgtccagcatcttcatatcggccaaggattggacgtaatcctaacgcctccctgtgcgcggaaggaacgtctgaaggccgtcgtccaactcaccacatccgatgggcggactgtggaggcgggcggtgattataccttggtggcacgagtttcctctgctcggctgcggatcatgcttgggcatgggaatgaccatggctctagcttgaaccagctgctgcgcggtggatacggacagatcgaaatcgccaattccgcattggtgcgtcgtgtcgccgaagatatcgcccgcacaccttatcgcggggcggctttcaatctttacgtccagagcaaggtcatcgaactgctggtaaacgaggtctcgatctcggaggagggcgatgatcagcgtattgcctatgccgttcgtgacatgcttctggctgatccggtatcgccgccgtccatggccgaaatctcgcgcatgatgggcgtacctccccgcaagctcaatgcccagttccgcgccattttcggcatgaccgcctttgaatggctggtcgattggcgtctgatccgtgcccgcgatctggtgatggatggcggcgtcacgatcaaggatatcgccttctcgctgggctattcgcacgtccccaccttttccgccgcctttacccgccgctttggcgttgcgccgtcccgatttaaggcgatgcgcgcacaggagcaattatcatgactgttatccggcgcaaatatcacaaggccaacttgggcatcatggcccttgaacagcgcatgatgttcgatggtgccgccgtagtagatgctgcccatgccgccgccgatgcggcagccaaggcgttgatccccgttgtgaccgcccccaccttggtgcgtgaggctgacccgtccaaggacggcggcaagaaagaggtcgcgttcgtcgatacctccgtcagcgcctacaagacactggaagcgggaattggcgctgggatcgagatcgtcgagatcagcggcggccaaagcggcctggcccagatggcggcctgggcggaaagccatagcggctttgatgccattcatgtgctgtcgcacggggctgagggggcactgtacgttggcagcgacgtcgtcaccgataccagtctatcgacagccgttgtgcaggcggaactggatgaaatcgggcacgctctgaaagccggtggcgatctgctggtctacggctgcgaaatcgccaagggagcggatggacagaaattcatcgatgatttggccgcgcgaacaggggcggatgtttccgcatcaacagataaaacgggcgccagtgtccaaggtgggaattggacactggaatatactgttgggaacgttgccgcagcatcattttattttgaaaactacgatagtctgcttgtgacaacgacatttagcggcacactcacgaattcagtaacattcaatcgcccatggactccttttgatatcgccgtcgcagctgatcctggaacgactttatatgccccatctgaagtctttacaggggggcagatatctcagacatcgccaacaacatacaattacactgcggctacttttgttccatccgtcactggcacttattcgatcaaggtaacagatgcggcaattattggatattcatttgacccaacagatgtcttcatgtccgtgtacggtgggagctttgactcggcgcaccccctggttaatcttctctgggcgaatgacgacacaacgaccagtgttgactacaaatcgagtatccaaaatgtcacactgacgtctggaaccagttatgtcgtcatcatgaccgcctatgacagtggcgttactggaacttatacttttgccatcatcggcccaggaagcgggacctggacatcgggaacagttgctgctccgtctggccccaccgtcactgatgcaaaaatctccatcacctcgacgccgaccggcaccagcagcacctacaaggtgggcgatacggtcaccgcgcgttgggacgattcggccagcggcgacaatcaatcgggcattaccggcgtcaccatggatttcagcgccttcggcggcgggtcaacggtgacagcaaccaacgacggcagcggccattggacggccagctatcaaatcgccagcggcagcatcgacggcaccaacaagaacgtctccgtcaccgcgaccaacggctcgggctccaccaccacggcggataccaccaatctgaaggtggacaaccaggccccgaccatcaccgccgccaagatttccatctcgggcgccaccggcacgggtggagccttcaaggttggcgatacggtttccgcgtcgtggaacgccacgggcgatggcaacagcgacatcgccgccagcggcgtcaacatggacttctcggcctttggcggcgggacggtggcagccaccaattcatctggcacctggacggccacctacaccatcgtcgacggcagcatcgacgggaccaacaagaacgtcagcgtcactggcaccgatgacgcgggcaacagcacgtccttcaccggcaccaacaacaagatcgtggacaacatcaagcccacggtgacgaccgccaagatctccgtctcgggggccaccggcacgggtggggccttcaaggtgggcgacaccgtcaccgcgtcgtgggacaacagcggtacgggcgacaacaacgccgacaccatctccagcgccaccgtggacttctcgcagttcggtggcggcgcggcggtggcggccaccaattcgtccggcacctggacggcgacctatgtcatcgccagcggcagcatcgacaccaccaaccgcaatgtcagcgttaccgccaccgacaatgcgggcaatgccacgaccaccgccgggaccaacaacaagaccgtcgataatcagccgccgaccgtcaccgccgccaagattgccgtctcgggcgcctcgggcacgggcggcgccttcaagatcggcgacaccgtcaccgcgacgtggaacaattcgggcagcggcgacaacaatgccgacaccatctccggcgtcaccatggacttctcgcagtttggtggcggcagcgcggtgacggccaccaacagcggcggcacctggacggcgacctacagtgtcgtttccggctccatcaacggtaccaccaaccgcaatatcagcgtcaccgccaccgacaatgccggaaacaccaccaccacggcaggaaccggcaacaagacggtcgataacgttttgccggtcatcaccagcgtggcgttgaacacctcgacctacaagatcggcgacaccgtcaccgcgaccatcacggtcagcagcgacagcgatagctacaccttgacgggcggatcggcgacgattgccggattcaccttcggtaacctgaccaagaccgccgccaccacctataccgcgacctatacggtgcagtccggtgataccgatctgatcagcggttcgcccaccgtcaacgtcgtgctggtggatggtcgcggcaatgccagcagcgcctataccaccacggtcagcaatgcccccattaccatcaacgcgcacgcccccaccgatgttgccctgagcaatagcagcgtcagcaccacgggcggcaccaatgcggtggtgggcaacttgtcctcgaccgacgccacgaccggcgagaccttctcctatgcgctggtggccggggccggttcgaccgacaacgccagcttcaacatcagcagcggcaatctgcgcgccaatgaccccaatgccttgggggcgggcacctattcggtgcgcgtgcgcagcaccgatgccgccggcaataccttcgataaagtcctctccgtcaccgctgtcgcaggggcttcggtcgccagccccacggtaaatgaagataccgattccggggccatttccatcaccaagggcaatgccgaaacctattacaagatcaccggcatcactggcggcacgctctattccgatgccgcctatacccaagccatcaacaacggcgacttcgtcgcccaaggtggcggaggcggtaacgggacaacgaccaatgtctatttccgccccaccgccaatcgcaacagcgccaacggcggcaatggcagctttgtcctgcaggcgtccagctccaatgccgatgcgggactgaccggcccccaggtcaccggcaccgtcaccctgactccggtggccgacacgcccagcgtcagcaatccgaccatcgccgaggacgccacctcgcaggccatcaccatcacccgctcggccaatgacggggcggagacgacacattacaaggtcaccggcatcaccggcggcacgctgtattccgatgcgggcctgaccacgcaaatcaacagcaatgacttcgttgccagcggtggggccaccaccacggtgtatttcaagccgaccgccaactggaactccaccaaggacggcaatgccagcttcgtggtgcaggcatcctcgtccaatgccaatggcggattgggcggcagcacggcgaccagcaccatcattgtcaccccggtggcggatacgcccagcgtcgccagcccgacggtcaacgaagacacggataccggcgccatcgccattacccgagcggcgggcgacggatcggaaaccagccactacaagatcaccggcatcaccggcggcacgctctattccgacgcgggctataccactcagatcaacaacggcgatttcatcgccagcgccgggggcaccaccaacgtctatttccgccccaccgccaaccgcaacaccaccaccggcggcaatggcagcttcacggtgcaggcgtccaagtccaacgccgatgccggtctcggtggcagcaccgtgatcagcaccgttgctctgacccccattgccgatacgcccagcgtgaccaacgccaacaccacgcccagcacccagacctcgtccggcctggtgctgtcccgtgcggtggtggacgggaccgaggtgacctatttcaagattaccggcatcaccaacggcaatctgttcaagaccgatggcacgacgcagatcaacaatggtgacttcatcacctttgccgagggcaacgccggtctgaagttcatgcccaccggcggcggcgatggctcgttcacggcgcaggcttcgaccagcaatgccaatggcggcctgggtggttcgaccatcaatgccactatcgccgtgggggcggcggttgccaacgccaccgtcaatgaagacaccgataccggggctgtcgccatcaccaagggcggttcggagacctattacaaggtcaccggaatcaccggcggcaccctgtaccgggatgcggcctttacccaggcgatcaacagcggcgacttcatcgcccagggcggtgggggcggcaacgggacgacgaccaatgtctatttccgtcccaccgccaaccgcaacagcaccaccggtggcaatggcagcttcacagtacaggcatccggttccaatgccgatgcggggctgaccggcaaccagatctccagcaccatcaccctgacccccattgccgatacgcccagcgtcaccaacgccacgacggctccgaacacgcaaagcgccagcggtttggttctgtcccgcgccacggtggacggggccgaggtgacctatttcaagatcaccggcattaccggcggcaacctgtacaagaacgacggcaccacgcaaatcgccaacggcaccttcctcacctttgccgagggcaatgctggcctgaaattcacgccgtccaacggctcgacatcgggcagcttcgtggcgcaagcctcgaccagcaatgccaatggcgggctggggggctcgaccgtcactgccaatatcgtggtcaacagcgccccggtcgcggcgggtggtgctctgaccccaccgggcggccaagtgggtgcggcttataccttcgccattcccaacggcaccttcaccgatcccgatgccggcgacactctcagttacagcgcctccgggttgcctacgggcctgaccatcaacgccacgaccggagccatttccggcaatccctccgcagccggaacagcctcggtcaccatcaccgccaccgacagccatggcgcgacggcaaccaaaaccggctccatcacgatccaagccgcaccggctcccgcaccagcgccagcgccgaccccagcaccgacgccgaccgtcgagcctactccggctcccaaggtcgatccccttggcgatcccaacagcaaggacaagggcgccgatggcttgaggacggtggttcgcgatacgggctccggtactggctcgggcaccgggacaggtcttggaaccgggaccggattcggcccgaccgtcagcttcgccaccatcaccatccccacggtgacgacacccacggcaaatgatgcgcctgcggctggtgcccggacgacgcaatcggccggtcaagtgtccgcacaggccgccgccacgggcatcgctccggcatccgtgacgatcattcccgccgtaaccaccatcgccgcccccaacgcctttcaggttgccgtggcgtcgaagcctgcgggggccggggatgccctggtggtcaacgcccccctcaaggacgcgttcgtggttgatggccgaatttcggtgaccgtgccgcacgacgccttcgccgataccaaggccaacgccaccgtgactctggcggcgcaacagttgaacggcgcggcgctgccgtcctggatgagcttcaacccgcaaaccggcacgttcgaaggcacgcctccgcccggtttcaaaggtgaggtcgtggtcaaggttgtcgcccgcgacaatgacggccgtgaggcggtgcagaccttcaaaatcgtggttggcgagggcaatcagggccgcaccgaacctggccagggcgcaccccagggtcaggggcaagacggccgggaccgcaccggggataccggctccgggaccaagcatgcgagcgccaagccgatgggcaagatcagcctgtccgagcaattgcgggccatgagcaaggaagggcggctggccaaacaggccgccctgttcagcaaccttaagactggcggcaaggccgcgtgatgttcagggggaaggatcatatgactcgtactttttccaccgccggaaggcttctggcatcggcctccatggttgcattgctggctgcctgcgcggtgacgcccgagcctttcaccaaggatgaactggcgacccaatccgtcgatgaccggacggcgatgttcaagggcggggagccgctgaccggccccctgacggtgtccgacgccatcgcccgcgccctgcgctacaacttggataagcggtccaagatgatggaggaggctctggccctgggccagaccgatgtggatcgctgggatctgctgcccaagctgacggcgaatgctggctataacgagcggtcggaaccgaatgccacccggtcgcgcgacctgtacacccagaccacctcgacctcgaatcccagctattcggcggatcgcgtttccaagaccgtcgacctgaccatgtcgtggaacgtgctggatttcggcctgacctacttcaccgccaaatccaatgcagaccgcgccctggtggcgaccgagcgccgccgtaaggccgtccacaacctgatttccgaggtgcgcttcgccttctggcgggccgccgcctatcagaccctgaacgatgaggtcaacaaggcggtggccgaggcccgtgtcgccttgggcaaggccaagcaagtggagcaggagaacctgaaggcgccggtcgaatccctgcgctaccagaaatccctgctggaaaccctgcgccagttgaccgccatccagcaggaactatccaccgcccgcatcgagctggcggcgctgatcaacgtgccgccgggcaccgagattaagctggcggttcccgagaccatggcgccgcctcaatgggacacgtccctggaccgcatggaggagcaggcgttcctcaataacccggatctgcacgaacagggctatctcagccgcatcaccctggacgacaccaagaaggccatcatcaagatgctgccgggcgtcacgttctcggccggtcggaattacgattacaacagcttcctgatggacaatcactggtacgaggccggggccaagctgtcgtggaatctgatgaatgtgatttccggcccttcggcgctgaaatatgccgagtccaacgaagaagtcgccaaggcccggcggatcgccctgcgcatggcggttttggcccaggtgcatgtgtcggaacgtcagttccgcaacgccagcagccagttcgagcaatccgacgaattgtggaaggtggacaagcgcctggccgaactttccgatgccaaggcggccaatgacgccagcggcatgctggaacgggtggctggccatgcctcggccatcgcctcgcagcttcgccgcttccagacctacgcccaggtcgagcaggcttacgccaagatgcaggccaccatgggcgatgatctgctgcccgacagcatcaaggccgagaaccttggtgacttgtcgaaactggtcgccaagcgtctggatcagtggggtaagggccagatggcggtgacggaggtcgcggccccggcttccgctcctgtggcggcacaggaggttgctccaactgaagataaatccgacctgctgtccaatgtcttccgctttatccgagagggattgaagcaacctgcggaaccggagaaacagtccgaagcggatgcgccgcgccccaatgacaatcgcccccccatggctggcgatgtggcatcggcacgctgatgcgtgccgcattatacgccttggcggtgatcctgccggttaccgcctgggcgcaagccccgcagagcgacatccgcgctcaattgacgccccgtgattacaccaccctggccgccgagatcggcgccaaggtagagcgcatcgccgtgcgtgagggggaacggtttaccaagggccaagcactggtagccttcgactgctcgatccagaaggcacaattatccgaggcccgtgcctcattatcggcggccgacaagacgttggcggtgaataagcgactgctggagctgcagactatcggcaagctggagaatgacgtatcgatggctgaggccgacaaagcccgcgccaaggaagtcgccagtgctgccgtggtcgccaaatgccagatcaccgcccccttcgatggccgggtggtggaacaaaaggtgcgttcccagcaattcgtccagcccgggcaagcgctgctggatatcctggatgattccgagctcgagctggatttcgtggtgccctccaaatggctggtctggctgaagccggggcacggcttccaggtggtcatcgacgagacggccaagacctatccggtcaagatgacacgggtcggcgcccgcatcgatccggtcagccagacggtcaaggtgaccggcaccattggcggacgctttccagaattgtcggcgggcatgagcggcaaggtgctgctggctccgccgccatgaacgagatcatcctctcgcttcttgatctgcaaagccgcattctggctgccaagcggcccgtcgaagtggcctttctggccgtcgatctgacgcacaccctgatcccctatcgccaagccgtgttgtggagcaaggctgacggcgtgatcaccctgtccggcgccgccgtggtcgaaaacggctcgccctacgtgctgtggctgggacaggtgtttggcattctgtccgatcttgacggccccgcagcattcaccgccatggatctgccgaagtccttggccgagcaatgggccgactggctgcccgctcatgccctggctttgcccatggacggagagatgctggtctatgcccgcgacgaagcgttcggcccccaggaaatcgcactgctggcccatctagccgcgctggtacggacggcgcggcgcgccctgttgccgcgtaccacgctgcaggaccgcatgaaggcgctggacagccgccgcacccgcattatcgccattgccgccttgggcgtcgcgctgttcccggtgaccggctccgtgctggctccggccgattccgcgcctgctcatccggtgatcgtgcgggcgccgctggacggggtagtcgatcatatcaccgtgcagcccaacgacacggtcaccgaaggtcaggccctgtttgaactggatgccacccaacttgcaggcaggctggatgtggcccgaagccaatggggcaccgccgaagccgaataccgtcaggcggcgcaggccatggtgttcgatgccaaggccaaggcgcaggtcgccatcctggcgggcaaggcggaagaaaaatccgccgaggttcgcctgctggaaaaccaattggcccgcatcgccgtcaaatctccccgtgccggaatcgccgtgttcgacgatcccaccgactggatcggcaagcccgtggtggtgggggaaaaagtgatggcggtggccgatgaaaaggacaccgaggtcgaagcctgggttgccgccgccgacgtgggcgaagtcaaggttggggccaagctgaccttgttcctcaacaccgcccctttgtccccggtgcgggccaaggtcaaaatcattgcctacgaggccagcgcccgtcccgacagcaccattgcccaccgcgtgcgggccagcctggacgagatggagatccgcccccgtctgggcctgaagggaacggcccgcatcgatggcgacaccgttcccttgatctggtggttgttccgaaagccgctggcgacaatgcggcaattcgtgggtttctgaccatgatcgccgcagccaccctcccgccgctgcgtgaagaactgaccattcatgatggcccggtggggcatgatggcgctcccacctggaccctgcacgatccgctgcgcaatcagttctatcggctaacatggtccgctttcgaggcgctgtcgcgctggcgcctgggtgacccggaacaggtggcggcggcggtctcggcggaaaccaccctgcggatcgaggcggaagatgtcggtgaggtgctggacttcctgacccgcagtcagttgctgaagccctcctcgcccatggacgtggcccgcctgttggcaattcacgatgcccataagaccggctggctgacttggctgttgcaccattacctgttcttccgcatccccctggtccgtcccaaccagatccttgatgtcatgctgccatgggtgggctggatgggcgggcgcgcctttcgccttgccacgctgatcgcactgctggccgggctatttctggttggacggcaatggaacgtttttacgacgacgttcgtggatcacttttccatggaggggctggcctcgttcggcattgccctgggggtggcgaagatcattcatgaacttggccatgcgctggtcgccaaatcctacggcctacgtgttcccaccatgggggtggcattcctggtgctgatgccggtgttgtacaccgacgtcaacgaagcctggaagctgaccagccgccgccagcgcctaatggtgggtggggcaggcatcctggccgaactgacgctggcggtgtgggcgaccctggcctgggggctgctgcccgatggcatggttcggggcatggccttcaccttggcagccaccacctggatctcttcgctggccatcaatctcagtccgttcatgcgcttcgacggctacttcctggccatggacgcgctggacatgcccaatctgcacaaccgggcctttgccctggcccgctggcatctgcgcgaagtgcttttcaggatcggtgaagcgatccccgagcgtttcccaccgcacatccaagccgcgatggtcggcttcgcctgggcggtatggatctaccgcctgaccctattcctcggcatcgccgcgctggtctaccacttcttcatcaaggtggtgggggtgatcctgttcgcggtggaaatggggtggttcgtgctgcggccgtttttcgtggagtttggtgagtggaggaaacgggccggggccatccgcaccaccaaacgcagccgcatcaccttcggcctgtttgccatcctgattcttctggccatcgtgccgtggaacggccgcgttgcggctccggccatgctgaagggcaaggaccatgtgacgctctacgctccctctccgggcatcttgtccgagattgccgtggcaaccggcgatacggtggcggtgggggcgattctggcccggctcgacaatcccgacatgacgctacgcctgcatcaggccgaacggcggatcggggttctaaaatatgaactggaagccgtgggattcgaggacaccttccgcaaccgagccaaggccattgcccaggaactggaggccgtaacagccgagcgcacggccctgttgcgggaccaggcccgcctgaccctgaccgcccctattgccggttcggtggttgatctgtcccccatggtgcaaaccggccagtggctcaaccccaaggaaccgattctgggactgacggccggagggcagatcgaagcctatgtggccgaggatgatctgccgcgcatcacggtcggggccagcgccaccttcatcaccgaaggcatggccggcgctcgtgccgctaccgtcaccgccatcgaccgcacggcggtaaaggcgctcaccgatccgcagatgacggtgccctatggtggctccatccccgcccgtttcgacaataaagccctggcgcccgacgtggcggtctatcgcgtgcggctgtcggtgggtggggaaagcgtttccacccccttgcgggggcaagtccacatcgatggtgaacgccgctccctgttggggcgcgtcttgcgtggggcggcggccgtcatcatccgtgaatggggggcgtgatggcggctccagcggcgatattcatcggaaaggaatctgaccttgcccgcaaggccgtcgtcagtttccacgagattggaatacctctggcgatcttcagcccggacgaaatctcgtcgattgattcagccgacatctcggaatccgtcttcatcctcaatcttgatgatttccctgaagacagcctgcggcctatcgaggcgatccggtcctgtttcggatgtgtcccagggatcatcgccatcggcaccggaggctcacccaccaaagaattcgatgccggggcggatttgcatctcgaccccagaaacgcggatgaactcttgcctagcgcgttcatggtgcttcgggacgcgttacttaagcaaggtaaaggtgacccatgaataacatctacatcgctacggggctgtgtttgtgaatgctgctggaaagttcaagtcaatgagtgagcccggagtgcgtcccaataaatcatccagagcacttgggatattgtcacgtcggccattgtgttcgcgctttcggcaacaaagctggctatagccccgaaggcgtccgagaaaaacaacatcatgctttgcgaactatgaccttgatgcatcatctatttacagggggcgccaatataattggttgctctcggaaagccgccaaaccgagatcgtcatgaacgatctcggttcacgaatagatgccgcctcgttgacaggaggcaatccaccgcattggtctcaggcagatccgtttctgttgctgtgccgcagatgtttcacctctccttccgacgtcacgtcagaaggcatctcgatttgcgttgcccaagatgggctcacggccagcgtctactacctgaagaacccctggctgctgtgcatcgagcagcgtgtctcgctgccggaaaggaaaagctccatgtcctccaagatcaccattcacggctcggtggtgaacgtcatcgaaaacaacaacgctcccatctatatcgatgcccgtgccgtggatgtggacgccagcgtcagcaatgggacgtctcgcgcatcggcagaaatcccaaatttcgagtgcagtcccgactacaccagggtttcgttgcggggtaaggcattccgctttggcgctttgcaggccagcatcatccgcattctgcatggcgccagcacgacatcctcgccttgggtttctgagcggcacctcttggcccagaccgggtcgcgcagcgaagccttgcgccatgtcttccgcaatcacgaccgcgacgccttgttcgaaatggacccgctgggccgggtccgactgcgtttgtgattgtcaaggtgaggacacggtgacggttcgtcaccgcccgagtcacgccccgtcaccgtacagaatctgatcccaccgccatgcttccgcgagttttttcatcgcggagcatgccgtcatggccgaacgtttcctatgccagaagcaactggcaaaacggtggggcatatcccaccgcaccctcgaaagctggcgataccggggaatcgggcttccatacctgaagctgggcggcaggatcgtctaccggatcggggatatcgaagcctacgaggcccagcagacccatggcggctttgagggtgacggcgatcccccggttcggttcgaagacgtcgatccccggcacatggatggtggtcgatgctgaccgccgccgcctttctggcctgggccaagaacgccggtcccggcgacaccatcacctatcacgaagggctgttgagcgaggaccgaacctccggcccgtcgctgctgcctgaaaaggcccgtgccgaactgcaccggatggcgggccacgccatggggctggccgtaagtggcggggtgctgctggttcagcgccgcctcgagccgggccgcatcgcctacatcgccatcaagcccaaagaccatcagccccggaggaagtggtcatgaccattcccaatcgcccccgccttgccgatctgctccagatgccgttgggtgaaatcgccgccctgtcgggcgagacactggccctgttgcaggaagaggccgacgcggcattgcgccacgccaaagctgccaaggatctgctcgacggcgctctggatcgtaaatacggccccctggccaccgaataccgccgccaggacggcaaggacaccgggaccgttcgcttcgacgacggcgcggtcaccgtggtcgccgatctgcccaagaaggtggagtgggaccaggagcagttggcggccaccgtcgaacgcatccgtgccagtggtgacgatcccgccgaatacgtcgatctcgccttcaaggtctcggaacgtaaatacggcgcctggcccgcccatatccgggctgccttcgaatcggcccgcacggtcaagaccggcaagccgaccttcagcctgaagcccattaccccctgagacacggcggggcagcccgttccgcaagggcgggcaggttccccttcggcgcccggtcaacgccccgtcgtttccaaccattggagaacctcatggccgtatccatcgttaccgccgaccagagattgtcggcggccggcaacaagacatcgttctgcattttcggcccacccggcgtgggcaaaacctcgctgctgaagaccctgccgcccgaccatgccgtctgtatcgacctggaagcgggcatgaagtcggtccaggactggcccggtgtcagcatcccggtgcgcagcttcggcgatttccgcgatctggccgtgctgatcggcggcatcgacccgtccgccgatcccaatggccattacagcgcgggtcaccaccagcatgtctcggcacagtaccaagggaccggcgttctcgaactgctggccagctgctccatcatcttcgtggattccatcaccgacctgacccgccaggccatggccttcgccaagcgccagcccgaggcgttctcggaacgcaccggcaagcccgacgtgcgcggggcctacggcctgctggggcgcgaggtaatccaggccctgaagcatctccagcacgcctccggcaagaccgtgatcttcgtcggtgtgctggagaaggtcaccgacgaattcaacgcctccgcctggcagccgcagatggagggatcgaaggctggacgagaactacccggcatcgtcgatcaggtcatctctatgcatctgttcgccgaagatgaaaccgacgggtggaggctggatgaaaaggccaccaaccgccgtctggtttgccaatccggcaatccttatggcttgcccgccaaggaccgttccggccgcctggacgtgaccgagccgcccgatctgggggcattgctgtccaagatcaaccgcgtttccgcctgaacccaggagactttcccatgtcctatgatttcaacgacgcccagccgcagatgatgccctcgggcgaactgatccccgacggcaccttcgccaagatccgcatgaccatccgtcccggcggcgttaacggttcgacgcccatggatgccgggttgctgaaggcggcggccgaaagcgacgccaagatgctggattgcgaattcaccgtggtcgaaggccagttcgtgcggcgcaagttctggcagaatttcacggtggcgggcggcaaggttgatgacaagggccagtccaagggctggaatatctcgaaggcgtcgttccgcgccatggtcgatagcgccttggggctgaaccccaaggacatgagcgacgctgccaaggccaagcgtgtcctgcagggcctgaagcagctggacggcatcaccttcgccgcccgcctcatggtggaaccggccagcgaccccaagtaccacgaccagaatcggctggccaatgtggtgctgcccggcgagccgcaatacgaggcggtgatgaagggtgaggcggtggagccggaacccatcaacgccaagccgcgcaagcccagcaccaatgccgccgccgggacgaacgccccggcctgggccaccgatgccgccccggcacagtcgtcccagcagcaagccggtgtgccatggacccagcagcccccggcgcaacagccgcaatccgccgcccaggcccagcccactgcggctggtcccgcttggctcaacggttgaccgggacggcgcctgctatgaccgacgatgaatggcaggcgcatgtcacgcgacaggcggcaaaggcaatcggcgaatggctcgaagcccgcggaaaactgcaccagcccataagggttctcgccctgtgggaactggaggccatggcccaggccgccatcagcagcttcgtggtgctgggctgttcccggatcaaggacgagccgggccagcacccggacctgacccggttcttgctggcctgagcctgtgcgcgatgtgcaaccgggaagccaggggctttggctatgtccatcgcctgcgccatgaccaatacccattccatcgcttctgttcccgccgctgccaggacgctggagcaaagattgcaggggatcatcacggcatgatcgacaaaaccgcccgcgaaacccaggccatcaaggatgcccgcccgcatttcgccgcggcgctgacggcgttgggcctgatggagcatttcttcaactgctccgccgccgatatcgaccggctgatcgaatccgccgttaccggctacgtcgagtccatgcagcgccaggctggcgttcaggagcgcagcggccttcccttcgacgatcccattccgttctgaggttgccgccatgctcgacctcaaccatggctccggctgtcagtaccagaagcccgaccgcgatcccggtatcaccatggcggtgaatgccgccatcgaccagatgctggtcacccgcaatcgctcccaggtggcccgccagtatgtcagcacctcggggatcggccgggaatgcctgcgccagattcagtacgactatctggccgtgcccaaggacgagggccgcgacttcgagcctcccaccttacggattttcgaggctggccaccgtggtgaagacgtggtggcggcttggctgaaggcggccgggttcgatctgcgcaccgaacggcgcgacggcaagcagtttggattcgcggtgctgaatggctgcttcaagggccatatcgacggctgcctggtcgacggcccggtggccatggactatcccgctttgtgggagaacaaggcgctgggcgtgtcgtcctggaaggacgtggtcaagcgcggcgtggtgttgtccaagccggtctatgccgcccagatcgccctctatcaggcgtacatggatctgcccgccccggcgctgttcaccgcgctcaaccgcgacacctgggaaatccactgcgagttggtgccgttcgacgcggccctggcgcaagccatgagcgacagggcattccaggtggtgcaggccagtgatgcccaggaattgctgccccgcgccgccgccgcacggacctcggtggtctgccgtggcggcaagacggcggctggctggcactccccgtgttcgtggcaggatcgctgctgggcttgtcgtggatgatcgatctcaacgacgtctgggaagcatcagcccgtcatgacctggacgatatccgcgaccgtttggccgccaccgcccatgactggctgccgggactgttccccaacgcccgtctggcccaggatcgccggacgctgcgttgtgccgatctgtcggggcggacgcctcgcaaggaaggctcctgtatcctgcatctgaccggcagccatgccgggtggggcttcgatcacgccaccggggaaagcgctggtcccatcgacctgatccatcacgccaccggcctgtcggagcgggacttgttcgaggaggccgcccgactggcccggctggatctacctgcaccgtcccgtcccaacagcccgaagcccacccatgatctggaggtggcccgtatcgtcggctccacccaaccgctggccggaacggtgggcgagtcctatctccgctaccgtggtatcggcgatccccaatcgccggacctgctgttccacaatgatctggccgatttcgacagccgccgcggctggccggggctggtgggcattgtccgtgatggcgcggggaatcccactggcggcatccatcgcaccttcttgctggaggacggttcgggcaaggctccgccgggcaaaaagatgctcggccccattgcaggcggcagcgtgcgccttgcgcccattcccgccgacggccacctcggcatcggcgagggcatcgaaaccgccctgtcggcctgggccatcttcggcattcccacctgggcggccctgtcggcgggaaatttgcgcgactggcagtggccggatggtatccgccgcgtcaccatctttgccgatgccggcgaggccggtcagcaggccgccgccgccctggccgaacagctcaccgccgccagcatcccgcccaccatcgtgtcgcccttgcacggagatgatttcaacgacgacctgcgcaaaggcgttgttgccagggattacgccccggccccaaccgtcaccgagccgatgccgttcgacttcaccatgctgtacgataccgccctggcgctgaccttcccgcccgacatgggcagtctcgccaagctgctgggtaatctggcccaagcccgcctcgatccggtggaagagcgtcaggtactggtggccatcaaggccaccacccgcatcccggtttcggtgacggaaaagcagatccgcagcctccgtcgccagggaagctccgccaacgccccgacggttcagccagcatggtttagccaacttcgtaccagcgccgacggcacgcccgagcgcaacgaggccaacgtcatcaccgccttgtcctgcgacgaagcctttgccggggcgctggtgttcgacgaattccgtcaggagatcatggtcaatcggccattgccctgggacgatggtagtcctgtccctcgtccatgggccgaggccgacaatgttcgttgtgccgaatggcttcagcgccgtgaggtcaatgtctcccccctggtagtcgcccgcagcatcggcgccgtggcccgcgatatcaccatccatccggtgcgcgagtatctcaccggcctacaatgggacggcacccgccgcctggaaagttgggccgtcgcccatctgggcgccaccgacacccggctcaaccaggcattcggctcgctgtggatgatctccgccatcgctcggatcatggcccctggggccaaggtcgaccacatgctgattctggaaggcccccaaggcgccaagaagtccaccgcgctgaagattctggcgggaggcgactggttcaccgacgaactggccgagatcggtagcaaggacgccgcccagcagatgcgcggcgtctggatcatcgagattgctgaactggacgccatcggccgagccgaggtgtcccgcatcaagtcgttcctgacccgcacggtcgaccgctaccgcccaccctatgagcgttacgtcatcgacgtgccgcgccagtgcgtattcgcgggcagcgttaatcccgacacctatctgcgcgacgagaccggcaaccgccgcttctggcccatccgttgcggccagatcgacctggaggcgatccgccgcgaccgcgaccagctttgggccgaggctatgaccctgtacagccagggcgccatctggtggctagacgatcccgaattgatcgccttggcccgcgccgagcaggaagagcggtaccagggcgatgcctgggacggcttgatcgaccgctggctggcctttgacaaggagcgggtcaattacggctatggcgcctacgacgactggcgcgaggtggaggtcgcccgatccgaaccgctcaccgacgtatcggtcggcgagatcctgcggaacgccatcggcatagagccgggccgatggacccgtgccgaccagatgcgggtcaccgcctatctgaaggcccaaggctggacccgataccaagccagggtgggcgaaagagccacgggctccagggaatggcgatatacccgcgcgacgggatagcgttactcctcggctgatcgagacactggtcgactacaagccaatagcttacgcccggccttcctgatcggcggcacgaagcggtacaagatgatggtggccactgcggttccagccaccgtcctatcgaacaggaaatggccgatcggtagatcctgctgtccggcctcgatattcagcaaggtgaagattgccgtgatcgccagcgcggggaaaaccacgacatagagaagccagacccactctcccaccatggggtagtcgttcgtataggcatcaccttccctggaaaaggcggtgaacttcatatccgtcgtgccatcatccccataaagcatgccgagacgcttttcaaggtcatgcaggtacggatattgccgctcaacctgaacgcaagcttgggagtacctgagcagcagcgcaaggaacatggcccatgttgcgctgacaatcgcatgccagggcaatgccacaactttgagcttcaagcctgttgaactgggctcggcgagcgcctcacgtaactccaccgggtgtccaacttccaagaacagaacgccgagcaccgcgattacaattaggaacagcaagtcgcgttccttctcccgctcccgctggagggcgaacgtgtctttgtaatgttcgtggagggtcttgagctggtcgtcggacatccgttcagttccccagaacctcttccagggcactcctgttgaagctgtgaatccaggtgacgccctgcccaaggagggccggggtcgagtaggaccggtcaagcttcaccgcaatgatcggcttcctgagttcgacggcctttttgatctcccacagctgccaattgatctcaccgatcttcgcccggttacgatggggagcgttgatgtgctccccgactatgaccagcatatgggtcgcctggctgattttggtggtcagcaccgccttgatcctatcgacctggtcgctctggatctcgctgggcgtcatgtcggcgaagtcgatgtcgatgttggggttgccagcaaaggcattgagcaatgcccgataatgccggtcattgtcgaaatcgaagctgaccaccacacgcttcttcgccatcttctttctccgccttgatctgcgacgcggcgagcggtgctgcgtcttcgcttccagtaagcccgaggcggcaacgatcaaagccccgagtatcaatctgatcattagactgcctgacataatgtcggacgcaatgcaattatagcgcgtcatattccgaaatatagtggcaaatttctccagtgcatggattgggccaccatatgtggtgtttgaaaagggcgtgacgatggatgccaacggtggtcaccaacccccagtgacgttggtgacaggttggtgacctgaaaagcatcatcctttcaattggttgacatgccttgtcaccaaccttctctggtcaccaacggggtaaaagctataagggccaagaaaaaattacgcacgaaaggttgatggtgaagcggccgatgccatctatgatgttctttttattttggctgagagagcgttcacacccggttggtgacatgtgaccggcaagccatcacggcatcaacgatctgattctgaacgacgattcccgtcaccaaccttgcatggagggcaaatgttcgccgctgttttctccggcatacgatcttcttcgatggcggcgaattgttgttgagaacctcacacccggttgttagcctccccctcgaccaaagccgaaggcccacagactcgtgagccttcatcatgaccactattctcgcccttgatctgggcaccaccaccggctgggccatgtgcctggccgatggttccattgtttccggcaccatggaattcaaacctggccgctatgaaggcggcgggatgcgcttccttcgtttccgatcatggctcgaccacctgctgaatggcgccaaggcaatcgacctcctgcatttcgaggaagtccgccgccacgccgggaccgatgccgcccacatctatggcggctttctcgcccatctcaccgcttggtgcgaattgaaaagcatcccgtaccagggtgtgccggtcgggaccatcaagcggcacgtcaccggcaagggcaatgcgggcaaggaagcggtgatcgccgccatgcgatccaagggtttcaatcccgaggacgacaacgaggccgatgccctggccatcctgtcctgggccaccgacacccagggaggcaaccaatgaactggacgcccaccctggtcgaagagcgtctcgccgaagccgccgacaccctgcgccgtttgcccgaagccaaggtccagggccacgccagcacttggccaccctacatccaggaaagcttgtctgccgaagacgcgacgtttcgccgtccgcctccctctgccgccgcgatcacccggatggacgaagccctgccgtggctccagcagcttgatcaggtcgatgccaagatcgtctggctgcgggctaaagggaagccgtggaagatcgtctgctggaatgtcggcctatcccgcgccaccgcccaccggcactggatgttcgccctgtgcctgatttcctggaagctaaacggcaagcgcatccccaagaacatctccctgcggcagatacttgatgttcgtaagatgcagtaaagcaagaaatgagacgctttactgcatgaccgaagaggccaaattgaggtaattgttattcatgctcacgaggggcggcaaacacgatcatttaatgatctgccgccccggtcgggcgaaagattagaacaagccaaggcgaggcggcgcggatatcgcggttcctccccggcacttcccctatgcgggcggcaacagtgccgaacttcgctagcgtcagccgaaaaatctaggtttccactccggtttccagtttccagcccaaaggcgcgcttgtccaacgacagcgcgcctttcacgttcccggctgagtggaaacctgggtggaaaccactgccggaaacctgatcgggtttccaccggcaggtttccagtttccacctgatccaggtttccatcgccatgcagcttgtccatcccgagccgggtctcccggcggtcggcttgatgccgcacgtccaggggctggtttacggctcggtgtgcagcggaatcgaggcggcaacggcggcgtgggagccgttgggctggcaagcggcgttcttcgccgagatcgagccgttcccgtccaccgtgctggcgcaccgctatcccgccattcccaatcttggcgacatgaccgccatcgacggtttggcgtggcggggcaagatcgacgtgttggtgggcggcacgccctgccaggcgttctcggtggcgggcttgcgcaagtcgctggatgacgcccgtggcaaccttgccctcacattcgtggaactcgccgatgccatcgatccagcttgggttatttgggaaaacgtccccggagttttgtccacccgtgacaacgccttcggatgccttctgggcggactggccggagaagatggtccggtcgtcccgccagggagaaaatggtcggacgctggtgttgtcgttggacccgcgcgcacagtcgcgtggcgggtgctcgacgcccaatatttcggcttggcccaacgacgccgtcgtgtgttcgttatcgcaggtgctggagaccgggccgatcccgtccaagtactttttgagcgcgaaggcgtgcgccgggatcatccgccgcgccgagaagcggaacaaggtcttgcccccacgcttgatgctcgcgctggccgaagcggcgagacgtcattcgccaccagcggcgggctgatcgccgaggcgttcggcggcaacaataccgctggccccatcgacgtcgccaccgcgctcaatgcctgcgcctcggccagcgggcgaatggatttcgagagcgagaccttcgtcgccaccaccttgcgggcccgcgacctgtcccgtggcgtcgacagcgactgtaccgatacgctgatcgcccacaccctgcgggctaaggcgaatctcgcccatcggcccgacatcgataccctggtcacccattccctacggggcgaaggcttcgatgcttcggaagatgggaccggacgtggcactccgctggtgcctgtggcgatcccaattcaggaggccggtgcccgcaccggaatcagcaccaccgatccccgtgccggaatcggcatcggcggtgacggcgaccccatgttcacgttgcaggcgggcaagcagcacgccgtggcgttcaacctgcgtggccgcgacggtggagcgcaggctgagattgatgccgataacatcgccagtctgcgggcggccagcggcggctccagccgcagctatgtggccttcgcccaaaatcagcgggacgaagttcggaccctggatgttgcaggcgccttggcggcggagccgggaaccaaacagcagacatacgtggcgttcgactgcaaggccagtgcggggtttcagtccgtcacaacggatggtgtcgttcccacactgcgggcgatgaatgctcaaggcagggagaatggtggggggcagttggcggtcaccgttccgctggatttgcggaatgccctgcgggatgccgaaaaattcgatgccatgaaccgccaggggcttggcatcggtgacgatggcgatcccgcgccgacactgtctcgggagcattcccacggcgttatcgccgatcttgccgtccgccgcctgacgccccgcgaatgcgagcggctccagggcttctccgacgattacacccagatcctctggcgcaagaaggccgccgaggattgtcccgacgggccacgctaccgggcgctgggtaattccatggccgtgccggtgatgcgctggatcgggcgccgcatccaggcggctggacaacggccatgacccgcaatccctatcgcattgacggtccggcgctggtgtcgttctcgggtgggcgcacgtccggctacatgctgcgccagattctggacgcccatgacggccaactgcccgaggacatccatgtggtgttcttcaataccgggcgggaattcgagcagaccctgcgcttcgtccacgaatgttcggtgcgctggtcggttccgatcacctggctggaattcgatcccgccgagccgttcgacaccagcgtggtcggctacaacagcgcggcccgcgacggcgagcccttcgagaagatcatcaaggtccggggcttcctgcccaacccgaccatgcggctctgcacccattacctcaaggtcaagcgcggtatcgccttcatgcgcgacatgcggggctacccggaatggatcaacgtcgtcggcctgcgccatgacgaaccccgccgggtcgcccgccagaaggccatgaacgaagccggcaaggagcggttcgagaccatcctgccgctggatcaggccaaggtcagccgccaggacgtttcggccttctggaagcgccagcccttcgacctcggtctgcccgacaacaacggcaagacgccgctgggcaattgcgacctctgctacatgaagggagcggccaccatcaaggggatcatgcgcctgttccccgaacgggccagatggtggatcgacatggagcgcaacgccccagcgctcggcaccctgaccaaaccggagatggcgctgttccgcgccgaccggcccagctaccgcgaattgctcaatttcgtccgccgccagcgggatttcgagggcggtccatccgatgactgcctgccctgcgattgcacggactgaccatgacccatccgcttcccgacacggtcgaggcttggcccatcgaccggctgatcccctatggccgcaatgcgcgaacccattcggacagccaggtcgcccagatcgccgccagcatggtcgagttcggctggaccaatccggtgctggccgacagcaagggcaacgtcatcgccgggcatggccgactggccgccgccaagtccctggggctggacacagtgccggtggtgatcctcgaccatctgaccgaggcccagcgccgcgcctacatcctggccgacaacaagctggccctgaatgctggctgggacgacgagaccctggcggcggaactgcacgcgctcaatgccgagggctacgacctggatctgatcggcttctccgccgaggaactggatgccctgatggctcccctcgacgacgagggcaacggccagggtgaaggcgacgaagacgaaatcccggaaccgcccgccgatccggtggcgcggcccggcgatctgtggatcttgggccgacaccgcctgctgtgcggcgacagcaccaatgccaccgatgtggagcgcctgctggccgaggccacgccgcacctgatggtgaccgatccgccttacggggtggagtacgacccagattggcgaaatcaggccggggtgtcgtccacctcgcgcaccggcaaggtggccaacgatgatcgggccgactggcgggaagcctgggcgctgttccccggcgaggtggcctatgtctggcattcggccatctacaccaggacggtggccgacagcctggaagccaacgacttcaagctccgcgcccagatcatctggtcgaagaaccgcttcgtcctgggccggggtgattatcactggcagcacgaaccttgctggtatgcggtgcgcaagaccggcactggccattggcagggcgcacgggatcaggccaccatctggaccatcggcaacaatggtgatgaggatgaagccacggtccacggcacccagaagccggtggaatgcatgcgccgcccgatcctcaacaacagcgccgagggcgaggcggtctacgagccgttcgcgggcagcggcaccacggtgatcgcggcggaaaccaccggccgcatctgcttcgccatggaactgaacccggcctatgccgacgtgatcgtcgggcgatggcagaagctaaccgggcagaaggccgtgctgaacggcgatggccggagcttcgaggaaatcgccgcggggaaagcggtcagcgccgagtgatccggcgcagggaatgctggtacttggcgtcggagggcttccagtcaagcggcttgcagccgaggcgcaggtcgcgttcccagaattcaaggatctgttggttggaatagcccttgccccggaagtattcgaagtcgctttgcgaccactgcggatgggccttcagggcggcggtggggcggacggtcagggccatactacttgccctcccgtccagcgttgtaggccgcttccagggccttcttgatctgccaaaccgccagttcgtggaagtccagacggtcgctcttgcgggtgtccagggtctccaggtcgaggatctgggtggcgatctcggtcagggcttggtctcgggtcttcatggtgtcggcctccgttttggtgaagccactaacgctctgtttcggctgcttatcaagccggttaatcatgcaatttcaaggctgtaacgtgatgcgccaatcccgccgcatgtccctggccgaggccgccgccaacgtggtgatcggctacggtatcgccgtcgccacccaggtggtggtgtttccggtcttcggcattcacatcaccctggccgatgatctgcggattggtctggtcttcgccgtggtctcgattctccggtcctacgctctgcggcgactgttcgaggtttgccgccgctgatccggccgacttggaatcgagacggcgggcggctactctttcggtccacaatttccgaggggaagagcatcatgagtaaatccgccatgtccaaggccatccgccaagccgccggttgcagcgtcgcccaggccgatgctgccgtcgaagcggcgctggccgctatcgtcgatggcgtcaagaccgagggccgcttcagcctcatcggtttcggctccttctcgaagtcggaacgcccggcccgtcaggggcgcaatcctcggaccggcaagaccatcgacattgccgcctcgacctcgatcaagttcagcacctcggcggctttgaagaagtcgctgtaagtcatggccgtcgatcccgagcatgtggcccgcgccgcgaatgatctgatgggtcactatggtcaggccgctctcgatgtggccaggaagcaagctgaacgcgcgtcgagggccggtgacatgccggccctcgatcaagccctgatggtgctgaccgaaatcgagcgccatcaggcggtttcgtccacaccggtgacgtaggcgtcggccttgttccaagacccttcgtcgatctcccactcggcgtcggtgctgttgaacagcttctcgaaggcggtgacctcggcctgctggggtgtttcggcctcgacctcgaccgtggtgctttcggtgacgtcgcgggtgatgatgacgctgtagtggggcatggccgtttgcctcaatcctggattttgtaaatacggccgcggccttcgatcttctcgctgatgacctcaagccccagctttttcttcaaggctccggcgatggcgccgcgcaccgtgtggggctgccaaccaaactcggctgtgatctcggcgatgctggcgccttcgggccgcttcagcatggcgatcagggcttcctgtttgctgccctggcgggtcttgcggacgcgctgcacttcctcggcctcgtccgggctgctgtcggcctccgtcaccggggttttcggctggtcggccatgtctgtcgccggttcttcttccggggcggtgtccgcgtccgtgtcggcccccatgcccaacgcctcgtaggcggcgggcgtggcccgcagggtgagcggggtgccgtcctcgtcctcacgccacaccggttggctgggttcggcgaggatttcctcggccaattccttcttgatcagactgatcagcaccaccttcaccgcgccgcccttcaaggcggcggtgatcggtagcacgaagccgccttcgcgggcgcaagcggcggagaggatgacggcctgggtgtcggaaagctgggtcatgaggtggtcctccaaggatggcgctggactgtcccgcgcctgtaccacctgaagccccgccagcctgaagccggtcggagcctgcccccgcgaaggcggggggcggaagggaaaaaccgctgatcaggtggcgaattcgccttcctggaaggcgctgtcgctgatggccttcagcatctccgcgtagtgggtcatggtcccggcgtggccccaattgatctcgtcgggcgtccagttgaagtgctcggcgcttaaggtctgcaaccgggccagcatggcgtcgaattcggccttcttggcgagaaaggcgtccagggctttggtgttgtcggtgcgcttcatcgtggtgtcctccggtgttcgtggggccattcatcgctctgtcggtcccacgtatcaacaggttaagcgtctcatttcattgcttatttcagcggaaatcgatcatgggattatccgtccgcgaatacgcgcgcaggcgtggcgtcagccataccgccgtgcgcaaggcggtgcagacgggccggattccccaggaacccgacggcaccatcgacccggtgaaggccgacgccgcctgggatgcccagaccgatcctggccggaaggcgacgacggccccgaagccggtcattgaagcgccgattgccccggcacctaagccccagcgcgaaaccaccccggctgttccggccgccgctggggccaccttcgcccaggcccgcaccgcccacgaagtcgccaaggcccagaaagcccgcatccaggtggatcgcctcaaggacgaggtggtcgaccgggcgcgggccaccgccctggtgttcaagctggcccgacaggaacgggatgcctggatcacttggcccgccagggtggccgggcagatggcggcggagatcggcatcgacccgcatgtgatgcagaccctgctggaagcccatgtccacgcccatctcgacgaactcgccgccatcgagccgaacttccgatgacgcatttgggttccgtggggccgacgctgtgctgctggcatggcaagacggggtgcgccccgatccgcgcctgaccgtctcccaatgggccgaccagcaccgcatgctatcgagccgggcctcggccgaaccggggcggtatcggaccaatcgcacgccctatatgcgcgacatcatggacgcgctgtcgcccaccagcccggtgcagcgggtggtgttcatgaaggcggcgcaggtgggggcgaccgaggcgggatgctgcttcatcggtttcgtcatccaccatgcgccggggccgatgctgtgcgtccagcccaccgtggagatggccaaacgggcgtcgcgccagcgcatcgatccgctgatcgacgaaagcccggccatccgggaacgggtcaaaccggcccgcgcgcgggatgctggcaacaccatgctgtcgaaggattttcccggcggcaccttggtgctgaccggggccaacagcgcggtgggcctgcgctccatgcccgcccgctacctgtttctcgacgaggtggacgcctatccggcttccgccgacgaggagggtgacccggtcggtctggccgaggcccgctcgctgaccttcgcccatcggcggaaggcgttcctggcctcgacgcccaccattcgcggcctgtcgcgcattgagcgggaatacgaggcatccgaccagcgccgcttcttcgtgccgtgcccccattgcggagccatgcagtggctgaaattcgaacggctgaaatgggacaggggccagccgggcagcgtccgttacgtctgcgaatcctgcgaccacgacatcgcggagcaccacaaggggggcatgctggctgcgggcgagtggcgggccaccgccatcgcctctgatcccggcaccgtcggctttcacatctcggcgctgtattcgccgccgggctggcagtcgtggcgcgacatcgcccgcctgtgggaggccgcccagggcaatgacgacgcgctgcgggtgttcaagaacaccgtgctgggggaaacctgggttgaatccggcgaggcccccgactggcagcggctctacgaccgccgcaagacctggaccaacggcattgtgccggcgggcgggttgttcctcaccgccggagccgacgtccaaaaggatcgcgtcgagatcgacgtctgggcctggggccgtggcctggaaagctggctgatcgaccacatcgtcatcgacggtgggccggaaaaagccgagacctgggaggctttggaacaggtattggcgaagatctggccccatgccagcggtatcggcctgaagatcgctcgtctggccatcgacagcggctatgaaacctcggcggtctatagctggggccgcaaaatgggcgttggtcaggtatctcccatcaagggtgtcgagggtttcaaccggtcatcgccggtttccggccccacctatgtggatgcgaccgagggcggcaagaagattcgccgtggcgcccgcctctggacggtggcggtgtccaccttcaaggcggaaacctaccggtttctccgtctggagcgccccaccgacgaagaattggccgaaggagtccgttacccggccggaacggtgcatctgccatcgtgggcagactcggaatggtgcaagcagttcgtcgccgagcagctggtgacggtcaagaaccgccgcggcttcaccaagctggaatggcagaagctcagggagcgcaatgaggcgctggattgccgggtttatgcccgtgccgccgcctggatcgccggggccgaccgctggcccgaggccaagtggcgcgatctggaagcacaactggccatatccgagttggcccaagccgaagaaccccaggcgggccagatccgccgcccccagacccgccgctctcggcgggtttttcattccagctatatgggctgatcccgatgaccctcgacgagatgaaggccgagcgcgagcgcgtgctggcgcggcgcaactcgctggtggcccgcgtcaccgtgggcgaccgcaccgtccagtatgatctgacccaggccaatcaggtgctggccgatctcgaccgccgtatcgccctggccgagggcaaggggcgccgtcgtcgcatcctgaccgtggccagcaaggggctgtgaccatgttgtcggccctgcgccgcaaggtgggcgcctttatcggcggcttcgaggcgggcatgagcaaccgccgcctcaagggcttccagcccagccgcgcccatctcaacaccctgatcgccgccgccgggtcggacatcacggcgcgcgcccgccatctggtccgcaacaacggttatgccgccaacgccatcgaaagctgggcgggcaatgtggtcggcgccggcatcaagccgtcctcgctgatcgccgacgccaccctgaaggcggcggtgcagaagctgtggctggcctggaccgacgaatccgatgccgaggggctgaccgatttctatggccagcagcggcgcgccgccagggaggtgttcatcgccggggaggtgttcttccgcttccgcccgcgtcggcccgaggacggcctgtcggtgccgctgcaattgcagatgctgccctcggaaatgctgccgctgacccggaaccagaccctgcccggcggcaatgtcatccgtcagggcatcgagttcgatcgcatcggccgccgcgtcgcctatcatttcctgcgccgccatcccggtgactgcaccgatcccggcatggctggggaaaccgtccgcgtcccggcttccgaaatcatccatgtgatggacccagtggatgctgggcagttgcgcggcgtgtcgcgctttgccccggccatcgtgaaactgttcctgctcgaccagtacgacgatgccgaactggaccgcaagaaggtggcggccatgtacgcgctgttcgtcaccacaccgagtccgggtgagccgttcgacatcgccgaggacggcggcaccggcgaccgggtgatggacgtccagcccggccaggtggtgatgctggaaccgggcgaggagatccagacctcggcccccgccgatgtgggtggctcctacgaggcgttccagtaccgcaccctgttgcagatcgccgccgccctgggggtgccctacgcctacctgtccaacgacatgctgaaggccaattactctaactcccggctggccctgctggaattccgccgccgcatcgacgcctggcagcacgcggtcatggtctaccagctttgccgggccgtctggcagcgctggatggataccgccgtgatggctggcgccctgaccatcaagggctatgagcccaaccgcgccggcttcactgcctgttcctggctgccgccgaaatgggactgggtcgatccgctcaaggacgcccgcgccgagatcgagcagatcgaggcgggtctcaagagccgcacccaggccctggccgagcgcggcttcgacgccgagcaggtggatgccgaaatagccgccgacaaggcccgcgaacagcggctggggctggttctcggcaccccgccgatgccgtccgcaccgacacagtaaggaccaccatgcacgatctgccccatatcgcggcccgtctgtacgggacgccgctgctggttgcccgcgccaagctggatgtgatcctgggcgccctcgctccccggctggccggacaagctatctccttcgatggcgatgcggctccctccgccgaaatggcggtgacgcccgacggcatcgccatcgtgccggtgatcggcaccttggtggcgcggtcgggctatctcggcgccgccagcggcctgaccgcctattcggacatcgccgatgccatcgaggcggcggccaccgatccgggtgtccgggccatcctgctcgacgtggattcctccggtggtgaggtgggcggcctgttcgatctggtcgaccacatccaggccatccgcgcccagtgcggcaagccgatttgggcgatagccgacgaggctgcgctgtcagcggcctatgccatcgcctgcaccgccgaccgcctgtacctcacccagaccggtgagatcggttccatcggcgtggtcgccatccatgtggatgaatccgccgccgatgcccaggccgggcgggcgtggagcttcattcatgccggtgccagcaaggtggatggcaacccccatcagccgctgtcggattccgcccgcgccacgctgcaggccgatgtggatgccctgtacgggaagttcaccgccctggtggccgagcggcggcggctatcgcccgacgccattcgggccaccgaggctgcggtctatcggggcgatcaggcggtggccgccgggctggccgacaaggtcggcacactccgcgttgccctcgccgatctcggcacgtccctggcgcgcccctccgtccgttcccccgttctgtccaaacccaaggagaccaccatgtccgagcaaacgggggacatccccgttctggcggctgtgccgtccgccgtcgaagcgactgccgagatcgagcagcgtctgcgcaccgaatattccgagatcagtgccatctcggcccaggccgcccgtctgggcatcaccatcgacgccgccgatgccctggccaagggcatccgtcccgaggccctgcgccgcactgtgctggatcagctggcgtcgcgctccgatgccgccgatttggtggcggctgcaccgacgggggcgacgcccaaggccgaaaccgaaagccccatcgtccggcgtgcccgtgacgctgccgcccgtcacggaggttgaccatgcccgtcctcattgcctcgcccaccctgggcgatctgctgaagttcgaactgaaccccagctacacccgcgagaccgtccccctgaaggcgggcacgtcctatcccctgggttcggtgctgggccgcatcaccgccagcggtgaatatcgcctgtcccccgccgccgaggtggtcggtgacgaaggcgccgagatggccgtcgccgtgctgctggacgcggtggatgccaccgatgccgcagccaccggcctgatcgccgcccgtggcccggtcatcctggccgatggcgccctggtgttcgacgcctcggtcgaccagccagccgaacgggtcaccaagatcacccagctcgccgcattgggcctcgtcgcccgcaccaccgtttgagagatgcccccgacatgaacgcgatcatcaacccgttcgacgcgggcggctattcgctcgccgaaatgacccaggccatcaacctgctgcccaacctctacacccggctcggccagatggggctgttccgcttcgagggcgtcactcagcgcagcgtcatcatcgagcaggccgagggagtcctcaacctgctgcccaccgtgccgctgggcggccccgccaccgttgccaaccgtgatgcccggagcatgcggtcgttcacggtgccgtggattccccatgatgattccatcacgccccaggacgtccagggcgtgcgcggcttcggtgtcgccgatgccgccgatcctctcgccaccgtcatggagcgcaagctgacccgcatgcggagcaagcacgcccagacgcgggaatttatggaggtcaacgccctgaagggcgtggtccgcgacggcggcgggtccaccctgtacgactacttcagcgaattcggcctcgcccgccagcaggtggatttcgccctcggcaccgccaccaccaacgtccaggccaagatccgcgacgtgttgcgcaaggtggagaccgaactgaagggcgagaccatgaccagcgtgctggccttggtttccccggagttcttcgacaagctgatcggccatgccaaggtcgagcaggcttaccagtattattcctccactggcgcccagccgctcagggaagacgtgcgccgccgcttccccttcgccggcatggtgttcgaggaatacagcgccaccgtcaccctctccaccggccagaccgaaaccctgatcccggcgggcgaaggcatcgccttcccgctgggcaccatggacaccttcgtcacctatggcgccccggccaacctgatcgagacggtcaacaccctgggcgtgcccatgtatgcccgccaattggcccgccaggacggcagcgccatcgacgtcaagaccgaggcctccatcctgccggtcaacaagcgcccgcgtctggcggtgcggttgttctcggggaactgaccatgtcggcctttgccgatgccctcgacgacctgttcgccgatccgaacatggccgtcaccgtcagctaccagggcagccccgtgcgtgccctggtgcggcggcccgaccgcgagatcgagttctctgacatcaccgtccatacggggacggcggtgtttgagatccggcggcgggagattccggcgccagtggcaggggacgtgatcgtccatgacggcgacagcttcgtcgtccagggcgaaccccgcctggatgccgagcggctggtttggacaatcgacgtgagaccggcatgaaactggccgcggccatatccggcgatctgcgcaagatcatggccgaggagatcaaggacgcggaagacgccgtcactgccgggatgcgccaagctgccgacgggctgaaggcggatctccgccgtcaggtcaccgaggcgggcatgggccagcgccttgccaatacctggcgggtcgagctttatcccaagggtcggaaaagcatcaaaccggcgggcttcgtcttcaccagggctcccaccatcatccgggcttttgaccagggtgcggtgatcaagtccaagcatggcttctggttggcgatccccacgcccgccgctggcaccggcgcccgaggcaagcgcatgacgcccggcctatgggaacagatgcacggcagccgcctgcgattcatctatcgccggggcgctccctcgctgctggtggccgagaacatgcgggcccgcaccggcaagcggggcggtttcgccaaaggcagcgcctcggcactccgctccgggcgcgggatgaccacagtggtgatgttcatcctggtgccgcaggtgagcttgaagaggcgcctcgacgtggacggcgtcgccgagcggtgggcttcggcgctgccggagctgatcgtcagaaattggagctcgtgatgccctccatccgcgaacagatcctcgtcgcccttttggcgcggctggaaacggtgcccggcgccacggccaagcgggaagcaccgttgcccgagacggtgcctgtcggtggtctgatcatcttgcgtgacggcgatcccggagacccggaggtggtgttgtcgcccgtcacctacctgtgggaacaccagaccgagatcgaaatcatcctccagcgcggccaggacgacgatagcgctgtgctggataccttgttgatggcggtggggaacgccctggccgccgaccgttccctcggtggtctggctgaaggactggattggggcgctcccaagacatccggcctcgccatcgacggtgccgccgccctgcgcggcgccatggtgccggtcactatccattacgccagcccagatccgctaggctgatttccaatccaccaaggactccaatcatgggcaagacgcgcgcttacggcgccgattgcgcgctgctggctgccttcgaggcgagctacggggtgcttccggccgacggctatacaaggctgtcgttcaaggaatccagcctgggggccgagcgcccgctgggctacgacccgctgctgggtcagggccgcgatgcccaggatccgttctatgaggcgatcaaggacgagggcgatgtcggtgtgccgctggatgtgcgggcgctcggcttctggctcaagggcttgttcggcgcgcccgccaccgccgataatggcgacactaccttcaaccatgtcttcacctcgggcggcacactgcccagcctcgccatcgagatcggccatgcccaactggcggcgccgaagttcttccgtcacggcggcgccaagctggacaagctgtccttcgacatggcccgctccggcgccgccaatgccagcatcggtgtgatcgcccagggcgagaccgaagcggccaccaccatcgacgccaccccggcgacctttgccctgaagcgcttttcccagggcagcggcaccatccgggtcggtggcggccaactggccaacgtggtcggcggcaagctgtccttttccaacaatctggagcgggtggagaccatccgcgctgacgggctgatcgacggcgtggacgagaccgaggctaccgccgagggttcggtggacatccgcttcggcaccgacaccacgctgaccaccgccatcgccgccgagagcccggtggcgatggaatatggtttcaccattcccggctcggcctttgccctgaccttccatctgccccgcgtcttcctgccgaaaaagaagcaggagatcaaaggccccggcggcatccaggccagctacgactggcgggcggcccgcgatccggtggcgggatatctgctccgcgtcaccctggtcaacgacgtggcggggtactgattatgatccgcctgaccatccccaaggaaccctactggatcgatctgccccacggtgtccgggtgttcgtccgtcccctgaccacggcggtgtacgaggccgcccggtcacgcggctggcgcatggcccgtgccatcgccgccgagcatgccgatctcaaggcggcgggggccgatatcaccggtctgcccgatctgtccgacgaggacgccctggccgggctgtcacagatgttgtttgcccaaggtctggcccgttccgccatcaccaaatgggagggcgtgctggacgtggccgatcaaccggcggaggtcaccgacaccgccatcgccgagctgatgcagcttccccgcatggccgagtccttcgtcgtccaatacaccgaaacccatgaaacggtcatcgccgagggaaacgtctccaggcccgcgccgaatggcacttcggcggcgggcctgactactgccgaggctgcggtggaaactgcgactgcccctatgaccgcaacacccccctgagtgaatccggctggcaagcctgggaattgctgaccggggccatcggcgccatccgcatcggtccccgtggcggcatcaccggtctcgaccttccggctctgctgatccaagcccaggcgctgggttacgaccagcccttgctggtccggctgctgcccttcgccgagcgcggcatggtggcgggggcggccaagctgcaatccgattcctgacagtgatggatcaccatgcgcgtccgcctgacccagctcgacggcaagctgcccaatcttgccctgatgcggctggcggcatggcatcgggcgcatggggatgaggtggtgttcacccgcagtgtcgagcgggagatgttcgagggggaatacgacgtggtctatggctcggcgatcttcaccgccagccagccgctgatcgcctgcttccgccaatgctggccctcggccatcgtgggcggcaccggcagcggctccgccatcaccgtggagcaggtggtcggcggatggtgggaacgctgcaattaccaggatcatcccggcttccagccctcgctcggcttcaccgccagaggctgccggatgaaatgccggttctgcatggtgccgggatcggaaggccgccccagatcggtcaacaccatcgccgatctgtggcgcgggccggggcacgccaggaagctgctgctgctcgacaacgatttcttcggccagccggaggagcaatggcaggcccgcgtcgccgagatccggggtggcgatttccgggtctgtttcagccagggcatcaatatccggctggtggatgaccgggtggccgaggccctggcctcggtccaataccgcgacgaccagttccgccagcgccgcctctacaccgcctgggacaatctgggcgacgaacgggtgttctttcgtggcgtcgaacggttggaaagggccggggtgccgccccggcatctgatggcctacatgctggtgggattcgatccggcggaaacctgggattgcatccattaccgcttcgaccgcatggtcgccgccggtatccgcccctatcccatggtgttcgatcccgcgcggcgtgatctcaagcaattccagcgctgggcggtgaccggcctctaccgtgccgtcccctgggccgattacgatccatccatccgaaggcgcaatgccgggagccaattgaccctggccgtcgcctgagacctgatccatggccaccaaatccgtctccattcgcctgtctttgcaggacggcgaaaccgtgcgccgcgccctgctgcaattgggcgaggatgggcagaaggctctgctgcgcatcgagacggcggcgcaaccggcgtcgaagtcgcttttggccatgaatgccgccagccaggatatccagggaggcatggcggccttcgcctcccggcttggccccatcggctcggtgatgatggcgctgggcccggccgggctggcggcgggcgcggccatcggcttcttcggcaaggccatggtcgagtccaccatcaaggtggaaagcctggaagcgcggctgaagggattagtgggtgccgcggcactcaccgaaaccaccagctatctctatgcccaggcgcagaagaccggcaccgccctggagacggtggtcggggcctattcccggctggcggcgttgcagaaggccgggatcatcactaccggcgagagccgtgccttgctggaaggctttcagtccaccgccatcgcgctgggggcctcatccgaacagttggagcagtcgctgttcggtttggcccaggggctgtcgtccggcaccctgcgggccgaggaactcaaccagatcgtcgagcccatgccggggctgctccaggctctcgaccgggccgccgctctgccctcgggcggcttccgccagatggtcacccagggtaaggtcacggcggatttcttccgcgacaccctgatcaaggcgctgcggggcttcgacgaggccgccaaggaaagtgccgacaccgccgagcggtccttcacccgcatgaccaatgcctggcagggatttaccaacgccccctggctgcgcaaggttctgtcgggcggcgccaatgccggggcggcgacgctggaatcgctgacgccaggggaatccacggtcaagtcgcggctggccgatctggaccggcgcatcgccgccctggggggcgagcaggccctcgacaagccgctgccagccggaacccattccgtggtggtgatggcggtcagggaggaaaacgaggaactgcgccgcctgctggccgaacgccaggatgtcgccgccgatctcgacgaaatcacccgcaagcgggcgggcatggaagcccatgccaagatggagcgcgaccgggtccgggccgagcaacgcgagcccagctatctcgaaaagctgaccgacctcaaattcgaggtggaatggcaggagaagctcaatacggcccgcgccgccggcaacgccgagttctcccgcaccaaggcccaatacgaggcggccaagggctttcgccagatcgagaaggagttgttccagcagggcggcgtctatcgcaccaagcccaaggaacaggagatcaaggatctgctggcccgcgaggccgaagccaagggcaatggcgagatgtcggcccaggctcaggccgaggtgctgggcttaaacctccaggcccgtggccaggagcgcctggccgaagccgcccgcaccggcggtcaggcccagatcgacgcagcgcgagccgccaaggtgttggagttcgccttcaagaacaatggcgcggcggtggccgaatacgaccgggcgctgcgccgcatcgatgccgccaagctgctggaacagaagaacggcctgatccgcaccatggggcaggaagccgccgccaatgatcgcctcgccgatgccgccaagggatcggtggccgacaccatcctggcggagcgcaccaactggctagccgaacaggcatccaaggggctgaccgacgccaatggcgaactggcccaatcctacgcccaggtgcagaaatcccgcgccaacagcgaagccgctcgcgccgtcgccgatctggagcgcgagatcgatgcccaggtgcgtctggccgaggcggtgcgcagcagtgatcgcaacaaagtccgcgacgtcaccatcgacaatgatgtcgccaaattcgcccgcagccacaagctggccgaggacgatcccaaggtggatgaataccgggcggctcgctctcgccaatattccgaggcagtcaaggacgaggcccgccaaaccacactggcctatgacgccacgctgcggtttgccgaggaactggccaagctcaacgagcagcggtccagcggcgcgttgtcggaggaagcctatacccgccgctaccgggaattggagcaggacaagctggccgccagccgcgactggcaggacggcgccatccgggcggtgcgggcctatgccgacgaagccagcaacgcggcggcttcggcagagcgggccatgtcgggggccttgcgggccagcgaggatgccttcgtcaaatgggccatgaccggcaagctggccgggcaggatctgttcaacagcctggccgaggaggctctacgggctgcttggcgcatgtcggtggtggcgccgctgttcggcggggccggtggcggcatcttcggcggcatgatcgccggcatcggcagcttcttcgcaggctccggatcaactggggccagcggcggcggcgcaacaccggtgcctgataccggcaatttcgccatcgcccattccggcggcctgatcggtctcgacctgctggaaacccgctcgttcagcccctcagtctttgccaatgcgccgaaataccacggtggcggtctggtggcgggagagcgccccatcgttgcccgcgtcggcgagggggtcttcacgccaaagcagatggacaatgccgatcgcatcctgaatgccgccttgtcgcagccaacggcggtgggcgtggtggtgacggtcaacaacaatgcatccggtacccaggcccgcgccgagcaatcccagggggcggatgggcgcatccatctcgacatcattgtcgaggagatcgagggccgcatgagccgccgcatcggtcgcggcgaaggcatggccccgatgctggagcatcgctatgggctgaacccggcggcggggacctatcggtaaggcttacccgcagcagccggtcgccgtgccgatctgtcgcgcctgctgaatcggcgggcaagcaacatcgccgtaggaacagaaaacgcagcaatcccacggctttgggcgaaggactgtcccgcagcccttgcagtcatagaaaaactggcaggcatcttcctgcatgacctcgacctccaaatgcccgcaatggggacaggtgatggtcgatgtcggggttacctcggcggcgctggtcatgaccgcatcgtatcgctcttgatgatccaggtgaagtgatgaccaccaccatctcctggcccgcccggctgccgttgccgacctatgacggctatgccctggaaccggaatcggccgtcacccgcaccgacatggaatccggtcccgcccggcagcggcggcggttcacgcaaacgcccacccgcatcccggtgcgctggcgcatgtcggcggtggacttcgccaccttcgaggcatggtttcgcctgaagctggatgatggtgccgattggttcgccatctccctgctgggcggaagcggcatcgccgcccatgaagcccgtttcgtcggccagggcaacaccccctacaaggcggtgcccagtcggggcggggcttggatcgtcacctcgacgctggaaatccgtcagcgccccatgctcgacgcgggggcgttggaaatcctgctggccgaggacgtggtcgctctcttcgccaacatccagactctccataccaccctgcatgtcggcttgcccgtcagcattcgctggtgatcgtccatgaccctgcaaaccgaactcgccgccgcaatcgccaaggtgaccgcggacagcaccctgctgcacaaggtggtgcatggccccgctggcgggaccgagtgccaggtcgtcaccgaaggtgggccggtcaagacggtggccagggctatcgccgatatcgacacccggcttcagtccagtctggaaaccctggatcagaaggttgcggcggcggcggccagcgcaggcatcgccgttcaaagcgccgacgcggcgggaacaagcaaagccgccaccgcggcaaacgcccaagccgcccgtctgtcggaaacgaatgccgccgccagcgcgtcatctgcatccggcaatgccgctgcggccaatgccagcgttgtcgcggcacaggcatcccggcaagcctcggaaaacgctgccgcccaggcggaacaggcccggacagccacggtggcggcgaaagtcgtcgccacccaggccgcaatcgatgcagccgcctcggcatcggcggccaacgcttcctccgtcgtggctggcgccagcgaagccgccgcccggtcgagtgcggaagcggcggatttatccgagcagcggacagcggcagcctcggctttggtcgtggccgccgaagccagcgccaccgcgtcggcggcccaggctcgtgcctcggaaaacgccgccgcagcctcggcatcggtcgcggctcaggccgaaaccgacggcgccttctgggccggacaggccgagagcttcgccgtcgcggccgaagcggcggccgccatcgtcgccgatgccaccggcctggatctgcaaaccctgattgtttccgcccgcaggggttcggattaccggacgctcggcatcgagttgttctgagaggaagccccatgaccacccttgcccattacctgacggtcaaggccgcccaggacaacgccttcgccaccatctcggccaagctcgacgatcccaatctgcggatggacgatttcgccctgatggtgaaggccatcgaactgatcgagaccgtccaggacaccgatgcctacgacgccctactgcgcaaggtggccgttaaggccgccgggctctacgccccggatttaagcggcgaggacatcctcatgctcacccgggcctcccggctgggcgacgtcccccatggcggggaagagcggtggatgctgctcaaccgcgacgaacggaacatggatgtcaccggggccgtgatgatcggcgaacgcaccctggaatggttcggcgaccgtgtcctcgaaaccttctacgcggagacctgatcccatgcccctgaccatcaccccgatccccaatgcggctcccttcacggcgttctccgacaatgtcggcatcttcagcaattccaaggcccgcgaaatcccggcccggctcaacgccatcgcgcaaggactgaaggatcacatcaacacgctgtggctggccacggccaccggcttcatcaacggcacggtgatcaccggtctgaacgccgcccttgccaagatcgagaccttctccaacgggatcgaaacccgcatcaacaatcagatggccgagttccaggtcaatctcgccaattacctcggaaccaatgccgggtattcggtcaatgccgccaacgccgccctgttcacgggcggcatcgtcgcgggggacgtcgtctacgacgttgccggaagggcctcatcgatccgccaggggccgcgtctgatcaacggcatcacctacaacgacgacggaaccatggcgggctatgccgagaaactgaccctcggcggcatcacctacacccgcgcctacagcttcacctacatgcccgacgggcagatcgccgccatcacggaggtttgacgatggatatcctgacgttcaacgcgctgaaacagtaccagcgccgtcttgacaccgatctgctcgatccctggaagcgtccggcctttgccgtggtcaccatgagcagctcggcgccctggggcacggtggtctacaaccactatctccaggagctttgccgccagcattacaatgacagcggctacatgcagggcagcaccagcagcctgggcaccgagttcttcaacaactggtatacctacggtcgcacggattccaatatctcctcgaccgacagcaattacggcgacggcaccgcccgatgtggccatctgggccacctggcgctggctatcggccccgacggttcgatgatcgggcgtgccagcccctattcggcgacggcactccgcaatgttggggtctgggtcaacaacaagaccaacaagaacctcgccctgttcatggagaaccagtacgcgggcgtggcgccgcgggccatcgcgcccggccgcctgaccggcactgagggttggcatctggcctggaccaacaccaagttctacgcccagaacaatttcggcacctacaacaagtacgggatgatcggctacaacgaaaaaaccggcacgctggtcatcaacgagaacaagaacggcggcacctccatgcggctgcacgtctattccaacgtcccaccgttcgacatctccgccagcaaccgccgcgcctggttcaacaatcttgatgagaccaagcacatcttctacgactggacggccaattcggccgggtatgccgagagcctctatcgcggcatcgtcattccctgcgacgacggcaagatcctcatcgtacggatggaacccagcaattactgcatgctggaccgcttcacgccgaatggcgccggaggctataccaaagaagccacccacaccctgagcacgaccaccacctacggcatggaatccgccgaccgcaacggcatccgcttccagatctccaacgacggcaaatacgtcatctgctaccagccctattactactatggggctggggccgaggtgtttctgatccgggtgtcggacgggaagtacgccttcctgcaataccaggattccggctatgggcggtcgttcgcgcccatccgcgacagcgacttcatggtctcctacagcccgaattccgacagcggctacggcatctatatgtcgcacatcgacacccgaaccgtgttccaggccgtcgccgacaagggcgacatgagctccaaggtgccgggcttcaacgtctacatcttcgacagcgcctatcactcgaccaactatccctacatcgtcccgatcatcggaggcatctgatcatggccggcaaaatcagcttcccccacggcaatgactggggcgtcatcggtcccgagggcgattacgacctgccggtggaatcgaccctgggccaccgcttccatctcgtcgatgacgaggtcatcgaccgctacgatggcgtcaccgatgatgaggtccgcgagattgatgccgcgcgcgtcgtcgagcggcaggccgaggaactccaggcggccagaaccgccctggttcgccgggttaaaaccgaagcggcgcagcgcatcgccaccctcgactggaaggtggaacgcgcccgtgagcgggatgccctgaacggcaccaagaccctccaggaggtctatgccgagcgcgaggtcattcggcgggcgagcaacgaggccgaagccgccatcgccaaactcgcctcccaggaagagatcctggacttctcctggtagccccttcccccgacccggaattcaatgccatgaccgaacaatccccggaaatctgggcgggcgtcgccacccagtatgtgggcgcctgggggcaggccgcccccatggtgcagatcgccgccatcgccgccacggtgatcattatcgccatcatcgcctgggcatggtcgaggaggcagggggcgccggatgcatccggcgtccctgtcgaagccttcgcccatgtggtcgaggaacaggcccgccagaccgaggcccttcgctccgcggtcgagggcctgtccgagatcgtccacgagatgcgcaagctgctggcggctcggaccttctgcccgttcccgtcgcccatgtgcgttcctggcaaggataaccatgcctgatccggcgttgtcgcaggcgctgaaggaggcgtttgcatcagccccggccggaacggtgattctcgatacgttggagatctggcatccaactttcattgagccgatccgggtggtccgagaccatgccgacctcactgcccggttggaggctggcgctccccgcgatggcggcaaacgggtgacctttgcagcactcgccttcgagttctccccgccgccggtggataccgccccggtgccggaaatcaccgtcacactcgacaatgtcggcagcgacatcaccgacgccctggaaggggccgccatcagccagcaggtgatcgagatcacctggcggccctatctctccaccgatcttaacggcccccatatggacccacccatcaccatgaccctgaccgaggtcgaggccgacaccatgagggttacgggccgcgcccgcatgctggatgcggggaacaagtcctttccgtccatcacctataccgctcggcgctttcccggtctggcacggtgatcttcgcagggcactgccctgcacccgccagggactcgtccctggaccccattccttcgagggcatcatgcattgggctgccgcttatatcggcctgccgtggtccgtccacggcagtgggccggactcgttcaattgctgggaattcgtccgcatggtgcaggcccgacatttcggccgcctgctgcccgagatcggcaatcccgaagacatgctggtcatgggccgcaccttccgcgaccaccccgagcggcaacgctgggccagggttgacccgcctatggaaggcgattgcgtgctgctgcgccgatcccgccatcccatccatgtgggaatctggctcgacgtggatggcggtggtgtcctgcattgcgccgagggcgccggggtggtgttccagcgttcggacgcgctcgcgctcaacggctgggccgtcgaaggcttctatcggttctcgccatgaccgcctccatcgtcatcgttaccaatccgttcgagccggtggccagccgctcggtgcatgcggtggaagccgggattacggtgggcggcctgttgcagggctgcggaattgccgaggattgctggtccgatggcccggaaatcctgatcggcggtatgacggttccggtcggcatctatgccgtccgggccatcagcgacagcgaggtcgtcaccgtcattcgctggccccagggcggcggtggcgatggcgggggcggcaagaacccgatgcggatcgtgctgaccatcgcggtgatggtagccgccatctatctaggccccatggcggcggtggccatgggctataccgccgccggcagtgccgccgccatggccaccgccggaatcgccctggccggctcgatgctgatcaatacggtgatcccggctcccaagccttccatgccgtcgctcaactggggcggcagcggcagcgccccggcccccagcccgacctattcaatccaggctcagggcaaccagggccgattggggcagccgatcccggtgatctatggccgccacctgatctatcccgacctcgcctccgagccctaccaggattacgtcggcggcgagcagtacctctaccagctccatgtcatcggccagggcgagtatgcggtcgagcagatccgcatcgaggacacccccatctcctccttcgaggaagtccagaccgaaaccgttccgcccggcagccgggtcaccctgttcgagccggatgtggtcaccgccgccgaggtggcgggccaggaactggtggcccccaatctggtgcaatcgggcgacgacggatatatcggcccgttcaccgccaacccggtcgataccacggccggggcgctgggcatcgacgtggtgatgccgcgtggcctctattacgccaatgacggcggcagcctcgatagccgctccgtccagtggcaggtcgaggcccgcgccatcgatgccgagggcggagccatcggcggttgggtggttctggcgcagccgtcgcatagcgccgccaccaacagcgcgctccgtctgtcgttccgctattcggtcagtccgggtcgctatgaggtccgcctcaagcgtctcgacaccaaggacaccgccgaacgcgccggccatgaaattcgctggggcgctctgcgggcctatttgaccggccagcccgatttcggcgccgtcaccctactggcggtcaagatgcgggccaccgacaatctcagccagcgctccagccgcatgatcaacgtcatcgccacccgcaagctgccggtgtggtcggcggcgggcggttggtcggccccgcagccgacccgttccatcgcctgggccttcgccgatgcctgcaaggcggactatggcgcaaagctggccgatagccgcatcgacctcaagacgctgaccactctggatgccgtttgggctgcccgtggcgatttcttcgacgcggtattcgacaccagcatgacggtgtgggaggccctgacccgcatcgcccgctgcggccgggccgtgcccatccagcagggcggcatcgtccgtatcatccgcgacgcgccccagaccatgccggtggccatgttcgggccgcgcaacatcgtcaagggctcgttcaagatcaaatacgtcatgcccggcgacgacaccgccgacgcggtgacggtggagtatttctcgtcccgcacctggaagcccgacgagaccaccgccaagctggcggacagtgctggcgacaatcccgccaaggtcaacctgttcggctgcaccgccaaggaccatgcccaacgggaaggtctctacatcgccgccaacaaccgctatcgccgccgcatggtcaccttccgcaccgagttggagggcatgatccccacctacggcgatctggtcgccatcacccacgacatgccccgctggggccagggcggcgaggtgatcgactggcgggccgaatccgccaagctgccttgggttggagcggttctggtcctgtccgaaccgctgacctggaccgagggcgccactcattacctggcgctgcgccgccgcgacggaagtctggcggggccgttccgggtcgagccaatggccgatgcgcccaccatggtgcgtctcgccgagccgctgaccgtcacgccttataccggcggctcggaggagcggacctacttctccttcggctcaggccaggcttgggcgcagaccgcccgcatcctcgccatccgtccccgtgccgagcaggtggagatcaccgccgtcgccgaggatttccgagtgcatgtgaactgattgcggggcgctgccccgttccccgccaaaggccgtgaggcccttggaacccactccccacagccgcctccgggcggctttttcattggaggttccccatgaccaaggacgctgtcatgccgcgtggcattcgcctcaacaatcccggtaatatcaaggaatcccccggcgacaagactcagtggcaaggcgagcgcgccaccgatgacgatccggtgttcgaggagttcgtcagccctgaagctggcattcgggcgctggcccgcatcctgctcggctatcaacgccgccatggcctcaacaccgtgacggggatcatcacccgttgggcgccgggttgcgagaacgacaccggctcctatatcgcccatgtcgccgcccgcctgggcgtaacccccgatcaggccatcgacctgaccaaggccgacactatggtcggattggtcgaagccatcatccgccatgagaacggccagcagccctacaccagagaggtgattctggccggggtcggcatggggctggggagcgcctgaccatgaatctgctcgatctcctcggcgatgccgccgccatcgccgccaatcccatcgcggggctggccaaggtggcgctggacgtggcgccggacatcgccagcctgttcggcgacgatgccgagaaggcggtcgggaaactggccgacaccgtccgcgccatcaccggcaccgacgatcccgacaaggcccgcgagatgctggccgaccccaatctggtgttccagcttcgctcccaggcgcaagaattcgcccatgctgaacgcatgcagcagatgaccggggcaatcaccacgctgaccgctaccctggtcgaccgccagaacgcccgtgccagggacagcgagttcatcaaagcaggcaggagcaacactcgcgccaacgtcctgctggtgaccgccggactcggcattgtcggcgggatcggcttcatggtgttcggccatgtggacggcaacaccgccgtcggcggctgcatcatctcggtggtgacactgctggcgggcaagttcgccaccgcgtttgattttgagttcggcggctcggcggattccgagcagacccgcactctgctggcgcaagcaccacccattggcaagtagcacaatccatacttcgcacgacgcggccgacctggggagagcccccggtcggccgctttttgtgtttgtgggctccgaacgggaccgccgccatccccaccctgtgcttgatccatcccccacgacggcgtctcccacagtccccgcgctttgccattcgggccgggtccgggtacccttgtcgccggaggtcagccagcacttttctggctgtcggtcacgcgctggaattcagcctgcaattcgggatagttcagggtgaggtagcggacgatgcggttattgcccagaagcctgtccagaaacccgttgatcaccacaagatcaaggtggtccgagccataagaccgttcgatttgacggaattcccggtccagcttggccgattcttcctccatcagggcaatctgttcatcggtgaggccgttgatccgtttcgcgcccttctggttgatcagttgggaggcgggcgtggcgctgaccagagatttggcgtagttgatcgaatatttattcatggcgatcatcagttgcgccgcttcgatctggcggatgggcagcattttcttcagctggtcgaaggtgttgatggggacgtgtttgtcctgcagcaactcgaccacctccgggcagattccattcagaatcgcggtcttgcggcggagataggcgacatcgacattcagggaactggcgatccgttcctcgggcacgccgtcttcgatagccttcaggatcatcctgtgttcctgaacgatggcgatgcgattgatccgcttgttgtaggtgaagccctcgtcatcggtggcgatcaggcaatcggtggacgtctcgcccatttccttcagaatctcgatgcgcagatgcccgtcgagcagcagatattttccctcctccgagcgatctttggccacgacgggtggttcgacgattcccacatctcggatggacgccgcgatctgggcatatttcggggttttctttactgctggaccgaccaggcggaggggctgaatatcggcaaaggcgatgcgctggctgcggcgttcaaaggccatttgtacggggccgggtgggggcttgcgtgccatggtcaagccacctccgcccgctgaatgcggcgggcaagattctgggggacggactcaagcccctcggcccgcagcagggtgacgaaattctcgtcatccagcagccgccggaacgcctcggtcatgaacagcaggcgggtgcgtgcggcattggcccgacggaccaggagccgcttcttctcggtgtcgtcccgataggctcgaaccaacgcatcggatgatggagcgtctttccgggttggtcccgtcggcctcaatcccttgccccggcgggaccgattctcgactagccgcttggcgatcaacagcttgcgaccacgcagcagattctgctcgtatgcctgctgaagcgcggactgaaccccaaggtcatccgcctcggcgatatccacggcgacactgaccggaatctgccccgattccacggcgcgcaacaatcgggtttcgcctttctccagcaggcgaaccacccctcggacatattccagcgtcaggccggttttcttggtgatttccggttcgctgtagccgcggcgtttcattccgccaatatcgtggagcagatcgatggcctgatggagacggcgggcacagttctcgaccaggctcttgaccatgagttcctgggaatccgcctcgaccacgaaggccggaatttcggactgaccaagcacctggaacgcctccagccgcccttgtccgcagatcaggtcgtagcgggggccattctgatcctcgcggcgagtgacggtgatgggcttcttgaggcccacctcggcaatgctgtcgacgatatcccggaagaccttctgattgcgcagccggggattgatcaccctgatccgatccatcggaatcagttcgatggcctgaccggaactttccaccatcatgcaacctccagcaatccgatccgcgcggccatgccgaacaacggttcaagggtgtcgaaacgaaaggagtccagcgcgattccgttgtgttcacccaggcggagcctcggcccggtcatgtcccggttgggaaggagataatagtcgcgcgcttgagcgttcgccgggtccatccgcacggcgatggtgatgtccggacagagacccgtatcaaggcggatatgccagcggagcgatcctgccggtgtttcctggcagcggacgatcaccagcgaggcggtgaattcccggttgatggtcaaaaggtcggtgaccgggtcttgctccacgcggccgccagtctgctcgatcccggcaacggtgtcggccaggacttgcggatgcatccgccgcaggagccggttgatctcgatatagcgataatcccggtcgggagtgaagccgaccagttcataggctctgagcaggctgccgaagcggctttgataggcgctgctggatgggcaatggtccgcctcgtcgatcatgatgccggacagaaagccccgccgctccagcaactcccgcaataactccagcatctcttcgctcgacagccgttgtgagcgcccccggatgatggtttgggccgcgtcaaatagggcatggtcgatgatcggggaaaaaacggcatcggcccgcacccaatcgtccggggcattttcgacacgctttttcttcagcttgaaggagcggcggttccagacattgttgccgatgtatttctcattgatcagcacctggtggacggtgccgcgtgtccacggtcggccgagatccgtggcgatcccgcgtccattgagcgccagggcgatctcgcgctccgacttcccgtccacgacgaaggcgcggtagatggaccggacgacttcaatttcctcgggcgggccgggaatcaggatgacgcggtcggtctgaatgctcttctgctcgcccctatccaggacgttcttctgggttccggtatggtcgatcaactggcggcgcagaccgaaaccggccgggccgccttgccgatagcccagcgtgatcaatcggcgctggccggtgaagaccttgaccgataattcccggcaatattcaccggccatggtccgcttcagggccttgatgatgtgggaaaacgggctgccgtcgttgtcgaattgctcggcgcaataatggacggcgataccggccagatcgcagcacagttcgtaataggcgccctcgtcgggattttggaaccggccccagcggctgacgtcgtaaaccagcacaatggaaaagtcggcccgaccgctctgaacgtcatctagtaaattctgcagcgccttgcggccatccagacgcaggccgcttttgccatcgtcacgataggtccgcacgatttcaaagccgtggtcatccgcgtactgccggatggcatcggcctgattttcggtcgagtactgttgatgctcggtggacatccgcacgtattgtgcgacccgaatacgtggaggtccggcggaagaaccgctgcttaactcctgtcggttctcatccgtcaccgtaactgcatccttcctttccttgatttgctgaatattacaaggaaggagagggaaaaatgttgccgaaaaagggcaaagtttttccggcaaacaccggagcgaacggcacatacgcagaacagatcgcagccgccttgcggaatgatctcggttccagtcatcagggggtgaagacggccatgcgctggactggcgccagcgagcggacggtcaagaactggttcgccggaaccaacggtcccagcggagaacatctggtcgatctggcccggcattcaaaggccgtcatggggatgtttctggtcctggcgggacactcagaaatgattgcgggcttggcgttgggggagattcgcacggcgcttgtcgatgccctggcggtcgttgacatgcatatggccgatgcatagaggacagtgattctgatgccgggataagcggttcagactcacggcgaaaccccatccgctaccgaatcatccgcccctggattgctatggcgtgccgggggtggctagcttccgaaacacaatcagcctgccagtttcggaatgcgaaccaccccatgagcatcgccctgcatccccgccatatgagcgcttccgagcgcctgaacgaagtcgcggaaatcctgtccaccggcgccatgcgtctgatcgaccggaagtccaggtctttatctgccaacagcggagacagttccctcgacttcaccgcccaccagagcgtccatgcaccggagaacaaacagaggattttccgcaaatgaccagcgcgctcctgacacaaatcgccgggctgcccgtcttgccgacgcccaggctcagggaaatgtggcgagacctgaccggcaccgagccgccgccctacaatcgcaccttcctggtccggcggctggcctatcgcctgcaggaactggccttcggcggcttgtcggcgaaggctgaacgccgcatcgacgatctgatttacgaattggagaatccgaagaaggccaagcccagggatctggacaccccgatccccggcaccaagctgatccgcgaatggcaaggcgtgatgcacgaggtgacgacggaggccgatggctatgaatatcagggccgccggttcaagagcctgtcggcggtggctcgcgccatcaccggcacccgctggaatgggccgctgttctttgggcttcggcgctccggtgccctgggaggtggcaaatgagcgctccaaataagccgattcgaaaagtccgctgcgccgtctatacccgcaagtcctcggaagaggggctggagatggaattcaacagcctggatgcccagcgggaatcctgcgaagcctatatcgccagccaacgggccgagggttgggtgccggtgcccaaccgctatgatgatggtgggttttccggcggcaatctcgaacggcccgccctgaagcgcctgctgaacgacatcgaggccgggctggtcgatgtggtggtggtctacaagatcgaccgcctcagccgctccttgatggatttctccaagctggtcgaggcgttcgaccgcaacgacgtcaccttcgtctcggtcacccagtccttcaacaccaccacctccatggggcggctgacgctgaacatcctgctgtcctttgcccaattcgagcgagaggtgatcggtgaacgcatccgcgacaaattcgccgcctcacgcaggaaagggatgtggatggggggcgtgccgccgctcggctatgacgtggtggcccgcaagctggtggtcaacgaggccgaggccgatctggtgcgccacatcttccgccgcttcctgcaggttggttccgccaccctgctgatcaaggaactgaacgccgctggccatcgcaccaagtcctgggtcacccaggacggcaaggagcgccagggcgtgcccttcaccaagaacttcctctacaagatgctcggcaaccgggtctatctgggtgaggccgtccacaagggtgaatcccatgcgggcgaacatgcggccatcatcgacctgaccacctgggaacggatcgaggcggtgaaggccgacaacgcccccatgaaacgcgcggcggcggcccgtgccaccaccccggccccattgaaggggttggtaatctgcgcccattgcggccgggccatgacgcccagccacacccgcaagaaagggcggctgtaccgctattatacctgcatgaaggccatcaccgctggccatgagtcctgcccggtgcgtagcgtcgccgcgggcgagatcgagacggcggtgatcgggcaggtccgcgccctgctgcgtgccccggaaatccgggcacgggcggaacggatggccccgcatgtggcggcgacggatctgcatgccgctctcgaccggttcgatgaggtctgggatgaactcttccctgccgagcaggcccgcatcctccatttgatggtcgaacaggtggccatctcgaccgacggggcggacttgcgcctgcgagccgaagggctgtccagcgtcgtggccgacatcaccgccctccagaacgctcggagcgccgcatgaccgacaagatcagtatcgacaccttcaccgttcgggtgcccctgaatatccgccggcatggcgggcgcaagctggtgatcgtgcccgaagacaacacagtacccgtccgccccaattccagccccgacgacacgttgctgaagggcttggcccgtgcatatcggtggaagcggatgctggaaaacggcagcgtccgttccctgaccgaactggccgaggaggaaaaaatcactccctcctatctcacccgcatttaccgcctgacccttctggcccccgatatcgtcgaaatgatccttgatggccgccagccgcgcaccttgcaactggccgatctgatggacaacattccgatggagtgggagcggcagcgggaagtgttggggcattgagttattgccccctcaacctgtgttcgccagaacgataccgacgtcctgctggtggggtttcgggtcaggcgccatcctgggtgtattcatagccgtgcagcatcgccgcttcggcacgcgccaactccttgccgagataggcggcgtggctgagttggctcacccagccgttctcgatgatcgtccagtagatggtgcgggaatctgccccttcgattcgccgcagcaaggcgttgtcgtagccgtaatgctcgacgagaagccgtctctccgggcgttgcggcaggaccacgaagtagcccgccttgtccatctcgatggatctcggctccccggcctggaccatcggcggttcactggtcgccggggacgtggtgggacaggacgagcagccgcaggacggcttctgcggggccggggtgttgtgctgttcgatagcagcgatgatacgccctgggtcgatttccccgatcaggtcgatgatctggacacgttgcctgaaggtcgccacctcgtccggggtcacgttccgcaaaatcgggcgcttgccgggtgagccgatcacccgcatggcctcatcgacgccgttttcggccagggccagcagcgtgcggcccggctggtgccccggcgggtcttggccgacaagaatgagcgtggtgatgtcaggattggcggcgacgttgcgcaccaccttgtcgatgccgatgttctcggtttcggtcttgccgaccatgcacagggccggtggcttgagatcggcgatccgtgctgccagggcgacatcgcccagggtggagacggccacggtgcaatcagccccatggcacagcacgaagtaatcgccgggaaccggcggccacccctcccggatctcgaaaccgcaggccgcatggagatcaagctgggggaacgcttgagccagagcattggaggccaccgccggatagcagtgggagcagccgaggcacgggtattcgacggcctccatccgctgccgccctgcccgagcctcctcgaccagggccatcgcttcggtgggcaggtccactgccaacaccagaccgtcaaggaattcgccaagacagccgcacttccggcatttggcgagaccgatggccgtccccaactcgtgatggatggtctccacggcagccagcatcgaacactcctgtttgctgtcgcaaaccatagcacgacgggcaccacaattcattagaatgacggaatattccgttgcgccatcatcatcgatctccccgccagaacagcagggccacgacggcgatggcggtgaaggctgctcccgcctggaaggttgccgatggaccgatgacggtccatagccagcccgcgatcacgctggcgaacaacagggcgatgccggacgccagattgaacacgccgaaggcggtgccgcgcaagctggccggggcggtgtcggcaaccagggtggcgagcagcccctgggtcatgcccatgtgcagcccccatagcgccacgcccaccatgacctgggcaatgccgctggcctgggccagcaccagatcggcgacgatcaggacagagaaaccgcccagcagcagcccacgccgccccagccggtcggacagatggccgaccggataggagcttgcggcatagacgatgttcatggcgacgaagaccagcggcaccaaagcggcttgcagcccgaccgactgcgcccgcagcagcaggaagccctcgctgaatcgggccagagtcatcagcatggcaatggcgactaccacccaataggccaggggaaatcgcttgacctcggcccaggacaggcgggccttggccgcccccttgtgggtggtaggttcccgaatgccgaagacgatcaacagcaccgccagcagcgccgggatggtggcgatccagaataacagccggtagtcgtcactggtcagccccatcaccaggatggcgatgatcggcccggcgaaggctcctaccgtatcgagcgactgacgcaacccgaaagcggctcccatcagatgcggcggcgtcaggtcggccaccagggcgtcacggggcgccccccggatgcccttgcccaaacggtcggcaaaacgggcggtgatcacccagcccaatgagggagccagggcgaacaccggcttggtcagggcggcgaggccatagccgaacagcaccagcggcttgcgcttgcccgcccaatcgctgatcgcgccggagaacaccttggtgatggccgcaatcgcctcggcgataccttcgatgatgccgatcgacagggcgctgacgcccagcaccgaggtcaggaacaccggcagcaggctgtggatcatctccgacgaggtgtccatcagcaggctgacgaagcctagtgcccagacgcccttgggaatggcttgcgcaggcaggccagaaccggcctgatctccgggaacaacggatggttcgttcattgccttgattatccagtggcaggggtggtgcggcgtatttcacgcgaagcctgcgccatgacgcccaccgcaccggtaagattaagtccgccgatcagcgcggcaacgatgatgtccggccaatgggtgccggtggcgaagacaccggtcgcggccagcatcacagccacattggcaatggcgtcgttgcgggaacagacccataccgagcgcatgttggcgtcaccgttccggtaggtgaacagcagtgcggccaccgtgccgttcgccgccagcgccaggaaacctacagcccccatgatctccgccttgggcaatgatccgaaccatgcgtgccatgccgtgcttcccaacacccaaagaccaaatgcggccatgctgctccctttaaccatggctgcgatggcacggtgtcggagcgcctttccaaggacaaaaaggctgattccataattggcggcatcactgagaaaatcgagagcatccgcctgcaaggcagcggacccggcgaataagcccgcgacgacctcgaccagaaacatggtcgtattgaccgcgaaggcgacctggaggatgcgcaagtagcgcggatcgtccttcgccccctcgcactgcccttcacaacaacccgacatgccgtttctcctgccttcaggatgaaggtggtggcaaaatggaccccgtagcagatactgggtcaaaaggtcatgacagaaaaatcgaccatcatcctcgggtaactggcgttgagcctggagatttgatgaaaaagccgattggctgaagctccgtatttatggtgtgggcttcgaccatcgggacgcagggtaatggtggcgaggcttgctctccacgacttcttccggttcaaccgtctttttccgtttccgccccaagccgatcttgatggccattgccgaccgatgctcggcatagctaggggcgacaaccgggtaatcggcaggcagggaccacttggtgcgatagtcggtcaccgacaggccgtggctggtcgccagatggcgcttcagcattttctgaggcttcccgcattccaggcaaatgaccgcatcgggctggaccgatttcttgatcggcacggccgggcgaggctgatcagtcaacggcacctgcattggcattgccgtggtgaccagcgcggcataggtggtgcggatcagatcggaaagatcttccaccgccacggcgttgccgcgaacgaaagcactgacgatacgggcggtcacgccaatcatagtggacctgcgctagcttaatgaggaagccaacattctcccgactcatacaagctggcaagctcgcattcgccgcgttcgagcgatgtatggcgcagaggatcgaaaaacgtagattgaggccgcagtgggtagtgtgtcgcagaatcaagcagtaaggaatatattgtctttatctggaagaatatggcggcacacaataaattatgcagaacaaatagttattgatttgtgcgaacccgttgcaggtcaatgccttttttccatttaccttgaagcggctcggtcaacggcttttggagaaatacgaggagagagaaggcaaattcggcctgaacgccgcagccccacgggacggcggtcaacggctataggccgaaaatggcgcagaacctcgggcttttgcccaaggctcactgcgtcagagaatatgttctttgaagtaattggcggagggggcgggattcgaacccgcgcagggatttaggtccctggacgatttagcaaaccgttggtttcagccactcacccacccctccgcagaggcggttgtttaccgcattggccggagcgacgtttctaaccaaagccaaagcgggcgtcaacgcttcctttttcatgatcggcaaaggaatcgtgggcggcttccgcagtggcacagcccccgggttgcggcgaaggcaaggccgtcgtaaggtgacaagtgttcggggagccggccgctcctatggggaggaggaatgcgcagtacgtggccgtttgtcgcgggagcgatcgttgccggtctggtgacgctgttcaccatgccgattctggttgcgaccggattcatcatgatggccgtgggggctgtcggtcatgacgaggccgtcctggcgggcggctcggccttttccatgcgcgacgagcgcgggcgcatcacctccaaactggtcaacaccacctacaccgtcgtatccgtccccatcaccggcgagccgcggccgcgccgcaccttgctgcgccagcgcgtgacggtgggcgatgacggagtcggccgggccagcctgtcggcgtggctggtgggggcgccgtcggaactgcgcaaagcgccgctgttccacatcagcgtggcggcccattccgccagtctgggcgatgatttcctgttctggaccgaaaccgccgggcggcgcacggcctattccctggccaacggcaactggctgttcgatgccgacctgccgctggtcaccttcaccttcgagcccgaggcgcggcgcatggcggccttgtcgcgggccgacgaggaatacgcctccaagggcggtgttgcggtgttcacctatgccgcgcccggccgtgtactgcgccgcgctgtgctggtggtggacgattccatgcgggccggcatgctgcgcgccaccctgtcggccaccaagctggtgagctattccgacgattccctgggtggccgggtggtggagttgcccctggggtcgggctcggtgcgcattccggtgacgcccaacgaactggacctccgccgggcggttctgcccgcgggaatgcgtctggtgcccattcagctctgggagtagggggctggagtttaacaggctgcgggggcactccgcttcgggggcttttgcccccgatcccccaagcaggaagcacagcttcccgaacccttcagctttttaaagaacgggtcagggcggtcgccctgccgcgcaagcgggctgttccgcagcctgtcagcctgaaactgtatttgcgaaaaactctatcccaccatccgccaccagcggcgggcttcccgcaccgcccattccgggccatggcccgagaacagcatggcatcgtcgtccagcaggcccagcaggcggttgatggaggcccacaattgctgttcgctgccgcccggcaggtcggtgcggcctacgccgttgcggaacagggtgtcgccggtcagcacgaagccgccgaaatccaggcagatgccgccgggcgtatggccgggggtatggatcacccgcaccggggcaccgcccaggctttcggtgggttcgcccgtgaaggtctgcaggctgcccgggcccttttgcggctggccggtgaaggtacggttgagatcgctggaggtggagatcacctgggtctcgtcggcatgggcgcgggtggagatgcccagcgtcgtctcgatctgatgggccgcgcccagatggtcgggatgaccgtgggtcagccagatcacctcgggcttggcgccggtggcggccaccgcttccaggatccggtctccgtctccgccgggatcgacgatggccagggtattggtcggcttgtgcaccacgagatagcagttctcgtaccagggcgggctggtcaccaggaccgacagggagaaatcgccgaaatcgccgaactgctgaagggtcatgactctggtctcgtccatgataagttccctcccctatagcgaagccggccacgctttccaagcaatgctttcgcctttacggcatggtaagggtgccgggtggacactgaagcttggctttcgggtggggcgaggagatctttttttatgcgtaagacgttccgtaagcttggtccgttcgtctcggcccggcgcgaagtttccgaatccggtctgcccggcgcgtcgtcggctcagacggcctcgccgtcctatcgccttgccttcgaggacgtggatttcctgctgcgccaggatctgcggccgatccggctgcaactggaactgctgaagcccgaactgctgcagcagcagcacggcatcaagtcgacggtggcggtattcggctcggcgcgcattccctcgcccgaacgcgcccaatccgtgctgggcctggccgaggaggaggcgcgcaaccgccccaaggaccgtcaggcggcccggcggctggccgtggcccggcgcatggtggccaacagccgctattacgaggaggcccggcgcttcgcccgcatcgtcaccagtacctgcgccggcgagcatgtctgtgatttcgtggtcaagaccggcggcggtcccggcatcatggaggccgccaatcgcggcgctgacgacatcggcggcaagtccatcgggctgaacatcgtgctgcccatggagcaggagcccaattcctacatcacgccggatttgtgcttccgcttccactatttcgccatccgcaagatgcacttcctgacgcgctcaaaggcgctggttgtgtttcccggcggcttcggcaccctggacgaattgttcgaggccgcgaccctgatccagaccggcaagatcgaaccgattcccatcctgctgttcggccgcgaatactgggaacgggtgatcaatatcgatgccatgatcaacgaaggcatggtcgctcccgaggacaagagcatcttcaccttcgtggaaaccgccgaggaagcctggaactatatcgccgacttctatcgcctgcccaaatagggtcgggacccgatttacaatcccatacgtaggtctacgatcgaggcgtgttgcagatccctggggagggatgggccgccgcctcgatccgccgcccaatcggcaggcagatcggggcggtgatacttccggtttcaggccgggggctggaaccgggtggggatcagccggcgcagatatttccccgtgacggcccggaaccgggggctgtggatgcagattcctcccagaaggccgacaaagcttcccagacaggtatcgatgaaccgcgactggatcagttccgccgccgatccctgccccatggtggcggcttcggccagcaggatggtcagcggggtgatcaggaccaccgcgaaggcgtagtggcggacgatcgcggtctcgatggcgaaggtcagcagcatcatggtgacggcgatgccccagttgttcagcggcagcgacaagaggccccaggccaggagcatgcccagtccggtcccgacgatgcgatggatctggcggttccagaccgcccgcagcgaggtgccctggatgaccgccaggcagctgaccggcacccaataggctttttccaggtgcaggacctgggccagggccagcgaggctccgacaaaggcgccgatgaccacggaatcgaagatgacgaagtcgaagctggccggcggcaggggctcgatcggcgcggcggggcgcaggcggagcatctccaggctgtagaaaaaggcgatcaggctggccagcagggcgcccatgctcagcaggccgaccatcagggggatctgcagcagctcgaccggggaataggcgccgatcgaggccgccatgatgaagaacaggctgccgggaacgccgacgcgatagtaccgacacagcatggtggtcagaatggcgatgaacaccagaaccggcatcatcagcacggggatgaggtggctcatcatccccagggtgtaacaggcgatcatggcgaaggccgaggccatcagcagcaccatgcggtggtacagcggcgtcggcggcagatagaggaacaccatgccgcccagggacgacaccatgccgtaatcgaggcgatcgaaagagcagcccaccaggagcggcagccccgatgccagggcggcggcaagcggcatctgccaggaccggtcgctgggatggatggtggtgaagtggcgcagttcctcggaaagaagcctcaggaaccgattccatgggggcatcatcgtcaccgttccagcgcttcctcgaaatagtgcagggtgcggacgcgcagcgtgtgcttcaggccgtcgtcctcgcggccgccgaactctccgtacaggtcgccggccatggaaaagaacaggccgagcagggcggggtcgaagtggctgccgcgtccggcggccatgatggcggtggcctgggcgacggggaaggcctccttgtaggggcgcttggaggtcagggcgtcgaacacgtcggcaatggcgaagatgcgggcggccagcggaatctgatcgccggccagcccggccatgtagccgctgccgtcatatttctcgtggtggtggccgaccacggcggcggcatccttcagccaggcgaagcgctggaccagatccaggccgtgggtgatgtgggtcttcatgatggcgaattcggcatcgtccagcttgcccggcttgagcaggatggcatcgggaatggccagcttgcccacgtcgtgcaggaaggcgcccttgagcagcgaacggatatgggccgcgtccaggcggagagcctcggccaggcgcagggcgtagagggtgacgcggtaattgtggctgctggtgtcgctgtcgcgcttggcgatggcgttgcccagcatctcgatggcgcccagattggcgtggagcagggagcgcgagcgctccaccagcgagcggttcaggcgcttgatcaccggaaacagcaggcccgaggtggccaggaccgagaggatcaccaggatcgaggtgcgcagtcccgcccggctggcgccggcgacgcggatgcgcgacacatggtagacaccctcgaaatagcccagccggctgttgtcgggcgcggtgaggccggtcagcaccagcaggtagagctcgccgccgacgatgtgcttggtgtaccaggtctcgcccggctcggggaaaacgtggcgggagcggtcgaccgcctgggcgagcatgccgttgtcctcggccatggcctcggccagggcggttttctcggcggtatagatctccgccccagcgaaatgatcggcggcgccgcgccgttccttcaggaaggcggaaaggcgggccttgacctcggtccgggtggtggaatccagccgcggcggaagctgcgtcgacagggtgcgggcttgctcgaccgcttcctcgacgaagggggcgtcgatgcgccgcatctcgtagataaaggtcgcggcgcccaggatgatggcgatggccagcccgccgacgcccaggcgcagggccaactggcggttcagcgaggcctcggcgggcatgggactcaggccttcttgcccaggtcgggcaggaagccattcatggtggtgacgtcgggcggagccggcgcggcggcggcgtcctgggcctcggccccggcggccttggcggcggcgaggctggccatggcggcatcgagggagggattggcttccggctgcttcatctcgcggcgcagggcccccagcttggcatccaccttctggatcacctcgcggtcctcgttcagcgccttggtccagtcggcgcggtccttgcgcagcgtctcttccatggtttcgagacgcttgatgaaaggttcggtcagttcgttgaatttgttggcgttggaggtttccatggcgatcttgatcttctcgatttcctcgatcagatcacgcttgatccagcggcttttcttgtcgagatcctcggtcatcttggtgaggcgttcgtccacctcggaattgatctggatcttcaactcataggcattcttcaccaactgggccatgtacatgagcaggccaccgcccacgaccaggatcactcccgccgcaaggctgatgatgaggacggtcgacatgctcatgaaaggaaaccgccacggtcggagaaaaaggcgtatccgacaatgtcgttgaatctcctgcatgatgcaagcccgccgccggttgtggacggtgacgttgatgttgctttgggctcgggcggggtgccaaagtggtcagaccggttgtcccgttacgagtcgctctccatgtcttccgccgtcagccagcgttccgccagggcctctttggccttttcctgtgccgggcacgcctatgcccatatcttcgagcccatcttcttcatcgtcgccctgtttctgcccgccgagacggggctgagctacgaggaggtgctggcgctgatcgtggcgggcaagctgctctacggcctgccggcgcccctggccgggtggctgggcgaccgctggagcaccgtgggcatgatggccgtctatttcattggcttaggcgccgcggccatcgccgtcggcctgtcccacgggccggtgatgctggccgtcgccttgggcttcatggggctgttcggctccatctaccatccggtgggcatttcctggctggtccgcaacgccgtggacaagggcaaggccatcggcctgaacggcgtgttcggcggcgtcggtcccgccctggccggtgtggtggcgggcgggctgatcgccctgtcgggctggcgcgccgccttcatcttgccgggcatggtggttctgggcaccggcctgctgttcctggtcatggtggccaggggcgtggtggtggagaacaagcaggaccgcaagcccgagccggtggccgatcggggcgagaccgtgcgggccggcatcgtgctgtcggtgaccatgctgtgcgccggtctggtctatcaggccacccagccgtcgctgcccaagctgttcgaggagcgcctgggcgagttcggtctttgggccgcggcgggcggcgtgacggtggtttatctgctggccggtctgactcagattctggccggtcatctggccgaccgcatcagccccaagcgcatctacctgctggccgcgctgatccaggtgccgctgctgctgggccttgcccatgccagcggcccgggcctgctgctggtggcggtgctggcggtcagcttcaacatggcgggcattcccgccgagaacctgctgctgtcgcgctataccccggccaaatggcgcggcaccgctttcggcctcaaattcgtcctgtccttcggggtctcgggcctgggggtgcccatggtgtcgctgatccgcggggctggcggcggcttcgagacggtgttcaccgtcctggccgtctccgccggtctggtggccctggccgcctggcaattgccgggagagcggggccgcacggcggtgccggcggcggcggagtagggggcatccgtcagtccaccttgccctggggcagcaggttgcggtcgaacaggctgatcagatcctcgcccgagaccgggcggctgatcaggtagccctggacctcgtcgcagcccttggagcgcaggaactcggcctgctccggagtctcgacaccctcggcgatggccttgagcttgaggttgtgggccagattgatgatggtggagacgatctccgcgccatcctcggtgaccttggactggccgtcgaagatgtcgttgacgaaggagcggtccaccttcagcgcgtcgatgggcatgcgcttcagataggacaggctggaatagccggtgccgaaatcgtcgatggagatgcgcacacccatggcgcgcagcgacttcagcacggccaccacctcgtcgacccgctgcatcagcacggtctcggtcagttccagttccagatactggggcggcaggccggtttcgcgcagggcgcgggccaccacttccggcacgtcggtctcgacgaattgctgggccgagacgttgacggcgatgcgcaccggcggcaggcccaggtccatccaatgcttgcactggcgacaggcggtgcgcagcacccattcgccgatatccgagatcactcccatggcctcggccagggggatgaagtccaccggcgagaccaggcccatttcgggatgatgccagcggaccagcgcctcgacgcctgacatgcgtccgtcctcggaatccaccttgacctgatagaccagacggaactcctcgcgggtcagggcgtggcgcagcgaggattccatggtcaggcgctcgaacgagcgggcattcatggccgccgtgtaaagctggtagctgttgcgtcccagatccttggcccggtacatggcggtatcggcattcttgatcagcgcctcgacggtggtgccgtcctcgggatagacggcgatgccgatggaggtggtgacataaagctcgttgtcgtccaccaggaagggctgcttgacgtgggcgatgacccgctcggccagcttggccacgtcttccaggtggtccagctcgggcagcaggacggtgaattcgtcgccgcccaggcgcgccaccgtgtcgccttcgcggacgcaatggctgatgcgggccgccgtttccaccagaacctgatcgccgacgccgtggcccagggaatcgttgatgcgcttgaacaggtcgaggtcgaggaacatgatcgccagttgctggccgtggcgatgggcgttggcgatggcgatctgcaggcggtcggtgaacagccgccggttgggcagggcggtcaggacgtcgaaatacgccaggttcttgatccgctcctcggtcttcttgcgctcggtgatgtcgctgaagatggcggcgtactgggtgatatcgccggtatcgtcgcggatgacgttgatggtcagccactcggggtagatctcgccgttcttgcggcggttccagatctcgccctgccagtaatcctgggcttccagcaccgtgtacatgtgcttgtagaaggtctcgtcatgatggccggacttcagcacattgggattcttgccgatgatttcctcggcggtgtatccggtcatgtgggtgaaggcgggattgacgaactcgatcttctgggtcgagtcgacgatcatgatgccgtccagcgaggcctcaatcaccttgcgggccagattgaggtccttgcgcgagcgcagcagggcggcgtcgcgctccttcagcgcctcgtccaggcggtggacgtattcgtattgcagggtggccaggatgtccgagaaggacagcaggccgaccagttcgccgtccatcctggtgatgccgatgtggcggatatgcttttgctcgagcatggcgcgcgccgccagcagcgagtcttcctcggtgatggtcagcagcggccggctggccacctcgcccacggtggcggggatggggccggttccggcgatcaggcgtagcacgtctcgctcggtgatgatgccgggaggcaggtcgccttcgcccagcacgatggcggcgtcggcacgggcattgcgcaattgggtgacggcctgggccaggctggcatcgttgggaatggtgaccatggggcgcgagatggccgagcgcaccgggcgcagcaccaggaagtgctcgacgccatggccgaggatgacgtcactctggctgacgatgcccatggcctcgccggcctcgtcgaccaccacgaaatggcgcacgccctccagcttgaagcgcatgccggtatcgccaatggtgctgccggtgcggatggtcttgaccggcgtgctcatcacgtcggagatggggcgctggaacgcctgcgggtcggcgatattgatggccagggcgtcgcgctcggtccagatgccgaccggcttgccgtcctcgaccaccacgatggacgagcaatgggcggccgccatggcctgggcggcttcgaggatcgtggacgcgggagaacagttgagcagggtcttctgtacgatgcggtcaatggtctggtcggatgacacggaagatttatcctgacttgaaacaagcgcccggcggccagtttcccccaactcggcgggtggcgcaactccccagggggatgcgggccgccgtaaaaccatggtcatagcgccccgtctcggctagagtgcccaagggtgttcgggtcgttgtcccgtaatagaaaggcggattcgcatcgatgtcggattctgcgaatggtcatcatggcaggaatgcccaggaagtcgttgaacagctgcggctggaattcgtcgatgagttgacggaaaccctgcaagccctcgacgtggagatggacgccgtccgtaatggacggggtgatatacgcaagctggtcaccgattgccgccgcgccgccgtccagtttcggggccaggcttccaattacgccatgcacaggctggccacggtggcccaccggctggaggaatacctggccaacactccggaagtggcgccgccccgcatgtgggacgacctctccggctattttgatctgatgagccgcatggcccagggccaggccgccgataccgaccccgccgcgctggtacgctccttgccggtcaagcttggcttcgatctgggcgacatcgaaatccgcaacgtggaagtgctgctggtgatgccccatggcgcccagactcgctttgtcgagcgcgagctgcagcaatgcggctaccgagtgtcgctgatggccgattcccttcgcgccttcgccatggtggtggagaccaagcccgatcttgtcatcatctcggccatgatgcccgacctggaaggcatcgatctcgccatggccctgtcggccatgcccagcacccgcaacatccccctggcggtgatcaccagcctggacaaggacgacgacatcctcaagctgttgcccaagaggattcccgtgctgttcaagggcgccaccttcgccgacgacctgttcaaggcgctggacaacctgttcctgatctaggttaccgcatcgcctcgccgaggaagccgaacatccgttgggcggattcctcggtgacggatctgtcgtggtgataggtgacctggctgccccggaccgtggtcctggaatggccgtccaactggcggcaatcccagcaatgggtggcgtcgggaaacaggtgccagtccaccggcgcccccgcagcccttgcggcttcgagaggcggcaggcagtcgtcggccggggtctcggtgtcttgaccgcccatcagcaccagcagcggaaccgtcacgtccgggccggcgatgtcgaaggccgaggtgaagcgcggccggatggtgaagcagccgggatacatggaaaccacggcgcggaagccctcgccctcggccagcgcttccgcccacgaggcgcgcgaggccagcaggccgaccatggcgccccatgaccagccagccagcccgacccgcctggcatccacataaggcagagcgcgcagatggcgggcggcctggaaggcatcgcggacgccccgggcgaaaaccagtccgttcctggggccaaagcagacggaatcgactccgcgctggttcagggcatctatcagcaggaccacatagcctttttcaactgcgcgccgcgcccagtccagcatggagagattggtgcggccgcgctgccccagcccgccgcactggtgaaacaggacgagagcgggaaacgggccggggccatcgggcttgaacagcgccatgcccggaaccgccgtctcggtcaggggtgagggggcggcgggaaagcttaggtcgggagcctggatggcggcggcacgcaactcctccggcggaggaacctccacagccagggcggaggcaccccagccgaggaggacggcgatcagcagccttccgatcattctagctttccgccccctggtcgctgcgcatggagaccatgaactggtgaacctcgcggtcgagggcctgggcctccgaggtcagccgcttggcgatgccctggacggaatcggcgctgcttcccgccgaggcggtggcggcggccaatgaccccatggcggaggagacctcctgggtgcccgccgaggcctgctggacgttgcgggcgatctcggccgtggcggcgccctgttcctcgacggcggccgcaatggctccggcaatttcattgatgcggccgatagtggcggcaatggaggcgatggcatccaccgcctccctggtgcgggcctggacggtgttgacctgattatagatttcgtcggtggccttggcggtctgggtggcgaggtgcttgacctctcccgccaccaccgcgaacccttttcccgcctctccggcgcgggccgcctcgatggtggcattgagcgccagcagattggtctggccggcaatatcgttgatcagggtcaccacctcgccgatgtgacccgccgcctcggccaatccctggaccagggcattggtccgctcggcctcggccaccgctcggcccgaggtgtcggaggattcgtgcacctgacgggaaatctcgctgatggaagccgacagttgctcggccgccgccgcgacggtggcgacgttgcccgaggcctgttcggcggaggaggcggcggctccggccttggctccggcctcgcccaccgcgcccgagacgatggcggcggcgctttccatttcccccaccgcctggaccaccacgtcggtgacccgcttgatggagctttcgatgtcgtcggccagttgcaggcgggcctgcttgcgctgaatgctggccgtccgatagctctcctgctgggcggcacgggcttcggcggcgctggccgcctcgtcgcgcagcacggcgacggcggcgatcaggaggccgatctcatccttgcgctcggtcttttccacctgggcggaatagtcctgacgggccagccgctgcgccacctcggccaggcgccgcagcggtgccgcgatgtcacgggacaagacggtgaccagacccagggccaccaggcagaccaccagggcgatgccggcgaagcgaagggcggcggcgttgaaggcggtgtcgatgtcgtcgatatagatgccggtcccgaccatcagtttccacggcgcatgggacaaggcgaccgaaaccttggggacgggggcgtcggatccggggcgggggaatttgtagaattccaccgcccggccggtcttcgacccctcgatcatgccgcggatataggccttgccgtcggcgtccttgctgtcgatgaaattcttgccctcccgctcgggccggacgggatgcagcacattgacgccgtcgaaatcgtagatgaagaagtattcatcgccctggtagcgcagggggcgaagggtctcgatggcctgggccttggcggtggcctcgtcgaactcacccgccttggcgcggtcatggaaggatttgagggtgccccgcgccacttcggccagggcggcgaccttctcgatgcggtcgttcagcatggattgccgcaactgggtcagcgccaccgcggacagaatggcgaatcccaccagcgccaggacggcggtggtcatcagcttcaacagaatccctgattttcccaacatggattcctcctccccaacattggcttatatcgccattggctaaagagtaatcctgtcggcctataacttccagcggtgaacgatcaggtcgttcagccgggatgacgccgggcgatcatgttgatggcccgcatgctgagcaccgtttcggccttgtggttgagcacctcgatgaacgaggtcaccacgccgcgatcaggcttggacttggaggccacggcgttttcgatggtgaccctcaccgacaggctgtcgccggggcgcaccgggcgcacccagcgcagctcgtccacgccgggcgaggccaggctggcgcatttggtcaggtaatgctcggcgtaaagccgcatcatcaggccgcaggtttgccagccgctggcgatcaggccgccgaagatggtgtccttggccgccaccggattggtgtggaagtcctgggggtcatagcgcttggcaaaggcgatgacctcgtcctcctccaccgtgatggagccgaactcgtgcacggcgccgggcacgtaatcctcgaaccagcggtcggtgatgggggaggcgaaggtcatcggatctcctatgtccacatgctttgtccggtgccggacaaagcagccctcatgcggcgggcgggcgcctccgcgcccttgccttccgcgccataaggcgcgcggccccttgggcctaaccaaagtgcgatgagataggctcgtcgcacttaggtctcaatccttgcgcttcgccttggccttggcgcggagcagggcgcgttcgtccttgagctgctcggcgatcaggaaggccagttccagcgactgggtggcgttgaggcggggatcgcaggcggtctgatagcggtcgcccagatcctcctcggcgacgccggtcatgccgccgatgcattcggtgacgtcctggccggtcatctcgaaatgcacgccgccggcatggctgccctcggccttgtgcacggcgaagaaggcgcggacctcggccaggatggcgtcgaagggacgggtcttgtagccgcccgccgccttgatggtgttggcgtgcatggggtcgcacgaccacaccaccttgcggccctcgcgctccacggcgcggatcaggccgggcagcacctgctcgaccttttcggcgcccatgcgggtgatcaccgtgatgcggcccgattcgttctcgggattgaggcggtcgatcaggcgcagcaggtcgtcggggctcatgccgggaccggccttgaagcccagggggttcttgacgccgcgcaggaactccacgtggccggcgtccatctggcgggtgcgctcgccgatccacagcatgtgggcggaacagtcgtaccagtcgccggtggtggaatcgatgcgggtcagcgcctgctcgtagggcatcagcagcgcttcgtgcgaggtgaagaaatcggtctcgcgcagttgcggcgtggtgtccgaggtcatgccgcaggcttccatgaaggccagcgtctcgtccagacggtcgcacagatcctggtagcgggcggcctgcaaggtgccggcgacgcagcccagcgtccactggtgcaccttatgcaggtcggcatagccgccctgggcgaaggcgcgcagcaggttcagcgtggcggccgactggttgtaggcgcggatcatgcgcagggggtcgggcacccgggcctcggcggtgaattcgctgccgttgacgttgtcgccgcgatagctgggcagcgtcacgccgtcgatggtctcggtgtcggccgagcgcggcttggcgaactgaccggccatgcggcccaccttgaccaccggcatggcggcgccataggtcagcaccaccgccatctgcagcagcacccggaaggtgtcgcggatattgttggcgtggaactcggcgaagctctcggcgcaatcgccgccctgcagcaggaaggccttgccgtcggccacgtcggccagggacgccttcaggcgccgcgcctcgccggcgaagaccagcgggggaaagttgcgcaagctttcctcgacctcggccagcttggccgaatcggggtaggtgggagcctgatggatcggctttgcgcgccagctttccggcgaccagttctcggacatgggacttcaatctcctgacgcttcgcgaggtgcgaaacggaaaagtcgttctctacccgacgtttcgtgcttggcgaaacccagggccgttctctatacgactccgggcgctatatttccagcccggacgacgagatacggccatgaaaaatccgaggatcgaaatgagcggcaccgccacccactggcagaatgtctggacggccaagcagccggaggaggtctcctggcaccaggatgatccggccccttccctggccatgatcgccgccgccggcttgcgccgggatgcggccatcatcgacgtgggcggcggggcctcggtgctggtggaccggctgctggagcggggctacgtgcatgtggcggtgctcgacatcgccgaggcggcgctgggccaggccgccgagcgcctgggaccgctgggtgacgacgtcacctggatcgaggcggacgtgctggcctggcggccggtgcccggcctgttcgacctgtggcacgaccgcgccgtgctgcactttctcaccgatcccggcgatcaggcccgctatgtggagcagatgaaggcggcgctgggacccgaggccacggtgatcctcgccaccttcgcccccgaagggccggagacatgctcgggcctgcccgtccgccgccacgatgtcgccagcctttgcgccctgctgggaccggaattccgtctggtggaggagacgcgtcaggaccacgtgaccccggcgggcaaggttcaggcgttccagtgggtgcggttcatccgcaatcctccgtcccggccggactgaccagggcggtgggctggaggagggtgatcttcccccgtccggtggcgatcagtccccgcgccgccatgcggctggtcaggcgggcgaccacctcgcgggtggtgccgatatggccggcgatctcctgctgggtcaggcgcacctcgcccttgcccgaggcgcggaccaccaggaaattgcccaggcgctgctccaccgtgcaggcgtggacctggtccagttcggccatcagccggaacaccagggtcgacagggtgcgcacggtcaggtcctggatcaccggctcggtctcgaacagggcgcgatagaggcggccgggcaccacggcgacagtggtgggctgctcttccgtctggacccaggcgggatagagcaggtcgttgaacaggctgttcatggccaggacgcaggtctcgcccggccggatagggtacagcgtggcttccttgccgccgggcagcagggtgaagacccgcaggcttccctccagcacgaaataggcgccggaaacgtcctggcccttctcgatgatggtcttgccgggcgggaagcgataggtcagcgcgccgctttccagcctctggcgtccctgggccgacaggtcgcggaaggtggcgatacgggtgatctccttcattcgggccccctttcccgatcaaggctgagccgtgccagcctatcactggtcagcccccggagaaacgcggcgatatcgcggatgtcggcctcggaaaggaccaggcgctcgaccacctcgaaccggccgccttccacggaccaggacggcgtcttgcccagccggcggtcctcgctgagggtggcgttcagttgcgcggtggccatgacgcgcaccgcctcttccaactcgctgaccgagccgttgtggaaatagggcgcggtcagcgccacgttgcgcagcgagggaatgcgccagaggccgtccaccgatccggccggcgccttgcccttgtccaccgtcaggccgtggcggcgggcaggggcggatcggctggccatcagcggggcataggggttctgcggccccaccagggaggcgccgctgaaattgggccccgaatggcacatgacgcagcccaccgactggaacagccacatcccccgcttctgggcgggatcgagcgccttgtcatcgccccggacgaagcggtcatagggactgtcattggtgaccagggtccgctcgaaggcggcgatggcctgggtgatgcgccgcatggtgacgggcgcgtcgtcgccgaacgcttcggcgaaggcttcgcggtaggaggggctggcgccgatgcgggcctcgatggcggcggcggacggcatgcccatctcgtcgggattgagcggcggccccatggcctgctcttccagcgatccggcccggccgtcccagaacaggcgcgactggaacgccgcattccagaccgtgggggcgttgcggcctccgacgatcccccggatgcccagggaggtggcgcgccggtcgccgcccgccccgcccagcaggtcatggcaactggcgcaggagaccgtgtgatcgagcgacaggtccttgtcgtggaacagccgctcgcccagggcgaccttggcgggggtggtgggattgtcgggcggcgacggcaccaccgccggcagggcgcgccagggataggggcggtctccgccatcgggtccggcgaggagcggccattcggtgcggccatcctcccggaccgccagggccggatcgggcagtagcggcgcgatggtctgctcggggaacgatgacagggtcaggatgatggccagcttgagggaaaaggcgatgattccgacgcccagcgccgcgcccaggaaccagcgcccgccgccgtccagggggccggggcggcctccggccggggccagatccatgcgaaccagcaaaaacagggccgaggtggcgaaaaggaccaccatggccccggtgcccagcacctgggatagatcggcgttcatggtcgtggctcccccgtgacgttgcggcagccatggtagcgccgcccaggagggggatctgtatccgagggtacagacggaaaacgggggcgtttgtagctccggctacagaatcgccatggggacctggcctagggtcccggcatcgttccttcgtcacaggagttccgacatggaaaagatgaagatcttcatggatacccatgatcaggccgacgggacctttccggcgggcatcacctccgagcagttcgcggccttctttgccggctaccaggaggcctgccgcgaggaaggggtcgtgctgctgcgggtggatgtggggctggaggccgggcgggccttctgtctcagcatggcggtcgatgcggaggcggtacgccgcgcccatgaccgggtcgggctgccctatgcctccatcacggaggtcaaggcggcgacgcccggcagcctgttcttcaaggcagcggccgcctgaggctttgtcctttccccggaagggcgggcatgatcccgcccttcttcggcagatcttcccgcacttgtcgtgatgctctatgctggctgcgtgacattgcgtatggagcgggggatacgcgtgccgatgcggaacaccgacggatcagcactgtcccgaagggtctggcaaaccgccctggtgttcgtggcgtttgtggtctcgtttgccgtctatgtctatggcgaaaagcagatcgaccgggccaacgagcagcgacagacctcgttccgtctggccgaccagttgcggcaatcctccgacgatctgacccgcatggtccgcacctatgtgaccattggggatcccctttttaagaaatcctatcaggacgtcctcgatatccgcgatgggcgccggattcggcccgaaaactacgacagcttctattggcatctgacgccgtcccgacccgagtcggtcggcccgcaagggggccgcgccatcccccttctggaactgatgcgcaaggcggggttcaccgacgaggagtttctccgcctcagccaggccaagtccctgtcggatgccctgacggcgcgggaattcgaggccatgcgcctgatggaggaagccggccccgaggatggccaagcccggctggccgccatccgcatgcttttcgacgacgagtatcgtcgggccaagacggggatcatgaagcccatcagcgagttcaacgaactggtggaggtgcggacgctggcggcggttcaccgggcggaagacatcgccttcgtcctgcgtctggtcttcgtggccttcgcggcggcagtcggagcgctgctctggctgacctatgccgaggcccgctccatcctgggcgggaccgtgcaagaggttcacgagcgcatcacccggatcgggcagggggacttttccgtgaccgggacgccggcttccaaaggggccgacagcgtgctggccgggctggacagcatggccgaacgccttggcgccatgcaggccgaacgcatccgcgccacggcggagttgaaggacaagaacgaggcgctggagcggtccaacgccgatctggagcaattcgcctatgtggcgtcccacgacctccagacacccttgcgcaatgtggtcagctatacccagctcatcgagcgccgctaccgggggcgcctggattccgatgcggacgaattcatcggtttcatcgtcgacaacaccaagaagatgaccctgctgatccacgatctgctggactattcgcgggcgtcgcgccagaccgagccgccggagccctgttcggccggcgcggccgtggagcaggctctggacaatctccgtcaggacatggaaacgggccatgtggaggtgcgggtcggcgccctgccggatgtggaggcggtgcccagccatctggtcagcctgttccagaacctgctgggcaacagcatcaaataccgcgctccggatcgcgccgcctggatttcggtgagcgccgagccggcggaaaacggctattggcgctttgccgtggccgataacggcatcggcatcgagccccagtaccacgaaaaggtcttcgagattttccagcgcctcaatccgtccgccgagaccgaggggaccggcatcgggctgaccctgtgccgccggatcgtccatcgcttcggcggcgccatctgggtggagtccgagcgggaaggcggcaccaccatcttcttcaccttgcgcggggcgtgaccggcgtcagggggcggattcggcgttggccttggcggcggccgacatgaaatcggccagcaggccgcggccctcatcatccaggcgggcggtcaggacctccgtcaccttggcctgggtggcggatttgaaggagtcccgcgcctggggggcgagaggctggaccgtcaggcggcgcccaagcccgtcggcgccccgctcggaatggtccagctttccgctcaactcgcgtccggcggcgatggcgcggcgggcggcttcgcgaacagcctgctgtccctcgggcgtcagcgtctcgaacgccgccctgttgtagatccacacatagggggaatacaggtggttggtcagggtggcatgggtctggacgtgatgatagcgccggcccagaaccaccgagggtggattcatctggccgtcgatcacgcccatctccagcgcctggaactcgtcgcgggacgacaccttgaccggcacggcgcccagcgcccggatcatggtgtccagggtctcgtagccgggaatggtgcggatcttgagcccggccatgtcggcgggcccggcgatgggacggcgggaattggtcaggacatgcatgcccccggcatcggcgaagcccagcaccaccaagccggtgcgccgttcgatatcggcggccagcctctggccgaactcgccgtcatagagggcataggcggcctgcggccggtccagggcgaagggcatgttcgtcaccgccatgggcgggtagaggggagccagcccgccggcggtcaccagggcggagtgaagcacgcccttggccaccagtcccgccatgtcgcggtttcctcccaactggccgtcggggaacagggcggccttcaggctgccgccgctcagttcgtccaaactgcggcggaactgcgaggcggcggcggcggcgggatcgaccgcggcatcctggggctgggaatgggccagatgaacgctggtctgggcgagggcttgcgggccgccgagcagcaccagcaggagaaaggcggcgaggaggcgatggggcatggcctatttctcggcaaactgaatggcgaattcggcatggccggggtcggcggcgttggccgcggcgcgtgcctgcagcaaccgcccggcctcgtcgttggagtagaccgcgccataggcgcggaacagctccgccgccctggcccaatcgccgtccacataggcggagaaggcctcgcgccagcgggcgacccgcgccagatcctcggggctggccgcgtggggctggccttccagcgcgcccaccagttcgaacagcaggatggggatgctggttcccgaagcgaccaccggccccagggggcgcaggacgaactggtcgcggaccacgtcctcaacctcgccggtgaccagcatctcggtgccgaaatgcttgttcagggattccacccgcgaggccaggttcaccgccgcgcccagggcggtgtattgcatgcggtcgcggcaccccacgtttcccgccaccgccatgccggtgtggaggccgtagcgggtgggcatgggagggtaattgttggcgatcagctcggcattgagccccgccgtggcggcccggcaggccagcatggcgcggcaggcgtgcagcacgtggtcggggtcgtgctggggggcgttccacagcgccatgaccgcgtcgccgatgaacttgtccacggtgccgttatgggcggcgatggcgccggacatgccttccagatagacggacaggtgatgcaggacgtcctcgggcgccatatcctcgctggtgcgggtgaagcccttgatgtcggtgaacaggatggtcagctcgcgccgctcgccgccgatctcggtgctggtgcccgactcgacgatgcgcctgaggatacccttgggcacataggcgccaaagctcctcagcgcggccttcatggtggcaagccccgccgccagggactgaacctccaccaccgggctgtttaccgtgatgtcgtgatccagttccagcctgcggatgcggtcggcctcgtcggtcagggcccggatgggggtggtcagcaggctcgacgcccagaccaccgcgacgctcgacagcagcaggaagcctgcgccgatcagcaggatcatgccgctggccttgcgcaggggaccgacgaagtcggcctcggcggcgatgacgccgatggtccagttcttgccgaagctttcgggaaagcgcgagaacgccaccagatattcgtcgccgtcgggacccagggtggcgcggaagcggtcaccggctccggcggcccgcttcctgaccgcgccggccaggacggggtcggagaactcctctgccttggcgatctccacatggccgccctgctggaccaggacgcgctgggggtcgggatatcccagcagccgcccttcctcgtccaggatgaagacctggccgttgtcgccgatccggtggtcggccagcactttggacagggtgtcgatggacaggtcggcgccgaaaaccgcgatgacctgcccgtcgtcggtggccagctggcgcgacagggtcaggcccggacgcccgatgctgctgaagacatgcaggctggaggtggcgatttcgttggttttgagcgccgccagataccagggccggttgcgcgggtcgtaagtggccttggccgcgcgctccagcccgaccacctcgccccaatgggtgatgtagatccagttgtcgacccgctcgtcatccaccgtgtcgatgaagcgcagggcgtaattggcgttcggcgggggattgcggcccttcagcgtgatgcccgaaccgggagggggaacccggatcacctcgtagaaggcgccgtcgcgggcgaagccgaagaacagggcgtagatatcggggaacttctccagcgcctcgaccagcgggcgcagtccttcgacccggcgaatggaatcgccttccgccttgccaaaagccaccgacaggtcggccacccggcccatggggcccagcagcgaaccgaccccggacaccacgtcggtggtggcgctgtccatggcgtgttcggccagctggatggccaactgggagttctggcgatagagaacagcggtcatcaacgccgtcagcggcagcatgacgctgaggaacatgacggtaatgccgacccgcaagcggatgcggaatcctttcggtggcatctcgctcccccctcttcgcagcgattgcgatgcctaagttatagtactatttgctgcggcgcaaacgcccgtttcaggggaagtatcagaaggcctcgccccgttccgcccggtcctgggcggcggccaattccgttgccagcgcctcgtccctggggccttcccaacggtccaggctgaccagatcggccaggggcaggcgcttgcgccagccgcgtgtttccagctcgggctgggcgaagaagtggctgaccttgcccaggcagagataggccaccggcaccacccgctcgggcaggcccaggatgtccttcagggccggctcggaaatgatggagacccagccgaggcccaggccctcggcgcgggccgccagccagagattctccacggcgcagacggtggaatagaggtccatggtggggatgtgggtgcggcccagaaccaccggccccacccggtcacgatcgcaggtgacgcagatgttgaccggcgattccaggatgccttccagcttcagcgagcggtaggtggcctgggcctcgccctcgaacatgcgggcggcctcgtcgttggcctgggcgaaggcgtccttgatgcgggcgcgggtttcgggcgagcgcaccaggatgaagctccagggctgcatgaagcccaccgagggggcatggtgggcggccaccaggatgcgggccagcacctcgtcgggaatggggtcgggcaggaactggccgcgcacgtcgcgccgcgacagcagcacccggtacagccccagcctgtccgcctcggtcaagacgtcgtcgccctggatggcggcggcccgatctgtcattcttcgctccctttcctcgccccggcccggaggcgggggtcactttagcgccacgatcttccatgaccaaggattgcgatctctgggtattcggctacggctcgctgatgtggcggccgggcttcgacgccgacgaagtctgccgtgccgtcctcgacggctggcaccgcgatttctgcgtctactcccgccactggcgcggtacgccggaacgtcccggcctggtgctgggcctggatgaaggcggctcgtgccggggcatggccttccgggtctgcgtggaacgggcggcggacgtggtcgaatacctcaacgagcgcgaactggtcgggtacgcctatgtggcccgctttcttcccatccgccttgacgatggtcgtgtggtccaggcctataccttcgtggcggataacggccatcaccattatgccgggcaattgccgctggagcaggcggcggccatcatcatggatgccgagggccagggcgggctgaaccgcgattacctgatcaacaccatccgccagttggaaagcgacggcttcgccgaggcagagctgcacgccctgctggtggaggtcgagcgccagaccggcatcatcgaggctggcgcggggatttagggagctttcgccaggctttccagctcgagaaagggaaaatgccccgaggcgagcagggcatcccgcacgccgcgccagaatggaatctcgcggatgatggactggccccggtccgcgatccgatcgcattcactcttgtcgtaagggcgcaggtggcgcaggcacgcctccaccaactggtcatagggggcggtgacgatgccgccgtcatacggcgcatcgctggattcctcggaaatgacgaagcggtggtttgtcagcagataggacaggcgcacctgttccatgacctgtccttccaactggtgaatgttgatcaccgccttggcattggcgatgtggttgtcgcgattggggccgaacaggcccatgcgcctctccaccttgaggccggcgccggacagggcatcgagcagaatctgccgccgttcggtcatgttgccgtaaaacaggacatcgatttccttgcgcgggaggtccgggatgcgctccaggacgggatcgtggcccaccgggacatggaccacgttggaaagccccagtgatttcagcaccgctacattggtcggcgaatagtcccagaccatgtgggcgcggcgcaggatttccagatagtccggattcatctcgaggatgcctccggccgtcagggattccagttggaataccgcggtcttggccagcaggtgcgggggaaaggcccctttcttcatgaaggccacatgaccgacgaggatgttgtaggcgtgatggtcgtaggtgttcaccgagtaccggtgcgggacgccaaggcggcaaaagctgctgcgcatggcatcgatgacttcctcgaaaatgggggcgtactcgttgaaggcatagtggaaaatattgatcggcatgcttccccgcgcgcggctcatgttcaaggaacagccccgttatagcttgcgtttgcctggcaggcgactccggtcggcgtcctaccggcagtgccgtcggtcttcggactgcgtcgaatcgccccattccaggctgatgcggaaggcccggcagatacggccgtcgcggggaagctgctccacggtgccgttcaggtctccgtgctgccacttgaccttccggccgggggcatcccaggcgacctcgattgcggacatcacggcccattctgccttggcgggaatgaaggccgggacggtgaagacggcccggacttcctgagcttcgatttccttgccgcgcggcagggaaggccccgagccgacctgctcggaaaccagcgcgatgagcaaaatggccgccagtcccgcagtggccagccacccggtccgtcccgcgcttttgtttggccggcgggcgttcggggccgccatggccgacaacgccagttccatttcaacgcgcaaatccaccggcagggctttggtggacgatgggttgtcgttcatggcccgcatcacccattcgcccaggcggcggagatcggagctgaccagaacccggcgctccgccgaggccagatcaattccaggggtgtggccgggcgtgttgtcgggcaggacatgcagcaggccacgcccccactcctccggccggaggctgccggccggcagggacagcagcagccgcgtctccagggcatcggccgcatgctgcaaggcatcggcggggtaggcgccgatgaaatatccgtcgtcgccgcggtgggtccacaccactccgggggcgggcggcgagaggatgtcgagaatcccgccggtcaccgccatatggaccaggccccgggggccgaggacgacgaagtcgggcagggacccgtcggagcggccagggaaggcgaagacagtgcaatcgtcgggcaactggtcgcgcaattcggcccagacgcgccgtttcgcgtccaggcggcgccccccgaaaccgtcgactctgtccggaaccacgttggccacggttgcacgccctcccacgatgcgcgcaggagaatgcataaacaatcatcagaagaaaagatgttatttaaggagtcttaatcggcgggtccgatgtcaggtcatggggcgttcaagatgcaggatgaagcggcaaagcgcctcatggtccgcatcgctccaccgtgccctgacctgggcggggtcggcgtgggccagcgctcccagatcggcgaaaagggcgcgcatcagggcggcgaaggcgctctcgttcagctgccagtgctcgtcccgggcgccgacctgggcgggcgtgaggtgggaattgaccagggtcatgaaccacacccggcgcttcttgaaatccgcgaaggcgtgaaccaccaccatcagaacatcgtcgatcagccgggccgcctcgggatcggcatggatggcgcgccagtcgtgcccgccgccgccgcccgggtggcggtccaggatggcggtggagcgacggcggcactgctcgaactgggtggggccgatcatcttgtccatggccatgtggaagccggggatcatccggcgcgacaggatgccttcgccaccctcgtcgccgctgcggggcggaaagaggtgggcgaagcggcgcatcaggatgcgctcgaacggctgttcgcgggctccctcccattgctgcgcggcgcggctttgggtgcagtcgttccaggcccgctggtaataggccttgaagcgggtctgctcggactcgacgaagcgccgggccagggcgcggatctggctggcggtcaggctgccgccggccttggccgcctccacctccagtctcgtcgcgaaatgcccgaccatggtggctcccaccccctggcagcattggggctcggcctcgggctgatcctgtggcggcggacgtcgggctgacatgacaagagcatagcgcgccccaacccgacagtgaaccgactctcgctcttgccggagcaaggtggtcaaatgggaggcctcgcaatggagatgtccccgccatgttcgaccggctgaaatccatgacccgcgtggtcaacgtgttcgaggacgagtattaccgtcccgcgccgccggactggctggcggtggccaccgacgtgcaagggtcgacggtggcggtggaggcgggcaagcaaaagacggtcaatttcgtcggggcctcggccatcgcggccctgcgcaatctttgcgcccccatggacctgccgtttcagttcggcggcgatggggccatggccctggtgccgcctcaattcgccgagcgggcgcgggtggaactggcgcgggcccgcggcttcgcccggcgcgagttcggcatctcgctgcgggtgggggccgtgccggtggccacggtgaccgaggcgggcggcaccattctggtggggcgctacgagccttcgcccggcaatcccttcggcatgttttccggcggcggcatgggattgctggaagaggccgtgaaggaacgcggccatccggatctggcgcggctgtcgcggattcccgaggaattggacgatggcgagtttcccgatctgaccgggttgtcctgccgttgggagcctctgggcacccaacgcggcgcggtgatcgccctgttggttgtcggcgacagggaccactgtcgcctgtatcgggatctgtgccggctgtccgacagcgaggccgaggggctcaagatcgcctcacgcgaaaatctcaagcccggctggccgggcgagagcaccatgatcgaggcccgcctggggcgggggcgtggtggagtctggcgccgctggctggacgtggcggcccagaccattctggtcaagcttctgtgcacgctggggctctccctgggcggcttcgatcccaggcgctatcccgaggaggtgatcaccaacaccgccttcgtcaagcacgacgataccctggcggtggtgttcgactgcccgtccgaccgcgtcgacgggctgcgggcctatctggacgagcgcgaggcacggggcgaattgcgctacggcctgcagatttccgacgtggccctgatggtctgtctggtggggaacttgagcgaagggcggcacgtccacttcatggatggaggcgacggcggctacaccatggcggcaaagcggttgaaggcggcggcaggggcgcgttgacagggccaaatcgcctccctagtgtgcctatatattgttcacaggggccgaaacgccaaatgtccgacacgctctccatcgcccttgcccagatcaatcccgtggtcggcgacatcgccggcaacatggcgctcatccgggccgcccgtgccgaggcccaggtccttggggccgatctggtggtgttcggggagctgacgctctgcggctacccgcccgaggatctggtgctgaagggcgcgttcctcgacgcctgcgaggcggcggtggaggagttggccgccgagacggaaggcggcccggccctgctggtcggcgcgccctggcgggtcaaggacaggctgcacaacgccgccctgctgctcgatcacggccgcgtcgccgccacccggttgaagcaccacctgcccaattacggcgtgttcgacgagatccgggtgttccagcccggtccggcgccgggtccggtgtcgtttcgcggcgtgcgcctgggcatcatgatctgcgaggacatgtggtacgccgacgtggccgagaccctgggcgagagcggcgccgagatcctggtggtgcccaacggctcgccctacgagatggacaagcccaccaagcgcctcgaccacgcccgcgcccgggtggaagagaccggcctgccgctgatctacgtcaatcaggtggggggccaggacgagctggtgttcgacggcgcgtccttcgtgctggacagcgatggcgccaccgccgcctccatcgccccctggcaaagccaggtcatcctcacccgttggacgcgcgggtccggcggctggcgctgcgacggacccaaggcgccgcccgtatcgcgtctggagggggtgtatcaggcgctggtcaccggcctgcgcgattacgtgggcaagaaccgctttcccggcgtggtgctgggcttgtcgggcggcatcgacagcgccatctgcgccgccatcgccgccgacgccctggggccggacaaggtgtggtgcgtgatgatgccgtcgccctacacttcggaggaaagcctggaggatgcggcggaatgcgcccgcctgctgggggtgcggctcgacaccgtcaatatcggcccggccatgggcgccttcgagaccatgctggcgccgctgttcgcgggcaaggatgccgacatcacggaagagaacctgcaatcgcgctcgcgcgggctgaccctgatggggatttccaacaagttcggccccatggtgctgtccaccggcaacaagagcgagatgtcgtgcggctacgccaccctctacggcgacatgtgcggcggctacgcggtgctgaaggacgtctacaagaccaccgtcttcgccctgtcgtcctggcgcaacggccagcgtccgccgggctgcctggggccgcaaggccgggtgatgcccgaccgggtgatcaccaagccgccctcggccgaactcaagcccgaccagaaggaccaggataccctgccgccctatgacgagctggacgccatgctcgaagccatgatcgaggacgagaagagcgtcgccgagatcgtcgccgccggatatgacgaggccgtggtgcgccgggtctggcgcatgctcgaccgcgccgaatacaagcgccgccaggccccgcccggggtcaagatcacctcgcgctcgttcggcaaggaccgccgctatcccatcaccaacgccttcaccgccctcatatgacacggggactcggatgacccggcatgtccatgacctgaccccctggcggcatggccaccagtatttcagcggcggagaggcggcggcggaacggcggaccctgatcgtcgtcgccctgaccgtggtcatgatggtggcggaaatcaccgccgggaccctgttcaactccatggccctgctggccgacggctggcacatgtccacccatgccggggcgctgggcatcgccgccttcgcctatggcttcgcccggcgccacgccgaggacgggcgcttcaccttcggcactggcaaggtgggcgtgctgggcggctttgccagcgccatcgtccttggcatggtcgccttgctgatggtgtgggaatcggcgtcgcgtctgcgcgaggttcagaccatcggcttcgacgaggccctgtgggtggcggtgatcggcctggtggtcaatctggtcagcgccctcatcctgggcggcgatggtcacactcatgaccactcccatgaccatggccacgatcatcatcacgaccacaacctgcgggccgcctatgtccatgtggtggccgacgcggtgacttcggtgctggccatcgtcgccttgctgttcggcaagtatctgggctggtggtggatggaccccatgatggggctggtgggcgcggcggtgatcgccaaatggtcctggggcctgatggccgagaccggggcggtgctgcttgaccacagcggcgacggcagtctggagcaggaggtgcgcgccgccatcgaaggcgacgccgacaaccggctggccgatcttcacctgtggcgggtgggcgcgggccactgggcggccatcgtctccatcgtcacccatcagccgcagccgccggattattacaagcgcctgctcgccccggtgcacgaactcagccacgtcactgtggagattttgccctgcgtcggcgaggcgaagtcctagagccttgttgccgcctcttgccgaatggtatagggggttagcgaaacacgctgtttttcaatggattgacatgacttctcccgtcgttcgctttgcccccagccccaccggcctgctgcatgtgggcaatgcccgcgttgcgctgctcaaccggctgttcgccaaggcccatggcggaagcttcatcctgcgcctggacgacaccgacctggagcgctcgcggcctgaattcgccgaggcgattctggacgatctgcgctggctgggcctggattgggaccggctggagcggcagtcggcccggctggacgcttatgccgccgccgccgaacgtctcaaggtttcgggccgggtttacgcctgctacgagaccccggacgagttggaacttcggcgcaaggtgcagttggggcgcggcctgccgccggtctatgaccgcgccgccctgaagcttgcccccgacgagatcgcccgcctcgaggccgaggggcgccggccccactggcgcttcaagctggagctggaagacgtgcgctgggacgattgcgtgcgcggccccagccattatcacggcggcaatctgtccgacccggtgctgatccggggcgacggctcgttcctctacaccctgcccagcgtggtcgacgacatcgagttcggcgtcacccacatcatccggggcgaggaccacgtcaccaacaccgcgccgcagatccagctgttccaggccctgggcgccgtgccgccggcctttgcccatctgccgctgctgaccggcgcgacgggcgaggggctgtccaagcggctgggctcgggctcgttgaaggatttgcgcgccaccggcatccatcccatggcgctgaattccctgctggccaagctgggcagttcggatgccatcgacatccgccacaccctggccgagctggaggcggagttcgcctgggacaagttcgggcgcggcacgccgaaattcgattccgccgagctggagcgcctggacgcccggctgatgcacaccgcgagtttcgccgaggtgcgcgaccgcctgggaatcgacggggccgacgaggaattctggctggcggtgcggcccaatctcaaccatttggccgaggccgaggcgtggtgggccatttgccgccaggatctcaccccggtgatcgaggacggggagttcacccgcgctgccgccgccctgctgcccgacggcgcctgggaccacgccacctggggcgcctggaccgaaacggtgaagcaggccaccggccgcaagggcaaggcgctgttccacccgttgcgtctggcgctgaccgggcgcgagaatggacccgagctgaagactctgctacctctcatcggccacgaccgggcaagggcgcggctgatgggcgagatcgcctaggggagatggttccgtgccgctggttctctacaataccctgacccgcaccaaggacgtgttcgagccgttggttcccggccatgtgggcatgtatgtctgcggccccacggtctatgaccgcgcccatatcggcaatgccaggccggtgatcgtcttcgacgtgctctatcgcctgctgaagacgctgtatccgtcggtgcgctatgtgcgcaacatcaccgacgtggatgacaagatcaatgcgcgggccaaggaaagcggcgagcccatctcggccatcaccgagcgcaccaccgccatgttccacgaggatatcggcgccctgaactgcctgctccccgacgtggagccccgcgccaccgcccatatcacccagatgatcgccatgatcgagcggctgatcgccaagggcttcgcctatgccgccgagggacatgtgctgttcgccgtcggcgccatggctgattacggcgcgctgtcgcgccgctcctccgacgagatgatcgccggcgcccgcgtcgaggtggcgccctacaagaaggaccccggcgacttcgtgctgtggaagccgtcgtccgacgacctgccgggctgggactcgccctggggccgggggcggcccggctggcatatcgagtgctcggccatgagcctgcagcatctgggcgagaccttcgacatccatggcggcggccaggatctggtcttcccccaccacgagaacgagatcgcgcaaagcacctgcgccaacggcaagcccttcgcccgcttctggctgcacaacggctggctgatggtggaaggcgagaagatgtccaagtcgctgggcaacttcttcaccgtgcgcgacctgctggaccaggcgccgggcgaggcgatccgcctagccatgctgaccacccattaccaccagcccttcgactggacggcggacgggttgaagcaggccaaggcgacgctggaccgcctttacaccgcgctgcgcggcgtcgccgacatcgacgccaacggctatgagggcgaggcgccgctggaagtgctggccgccctgaaggacgacctcaacacgccgctggccatcagccatctgcacgaactggccggggcgctgaacaaggcgaccgggctggaggacaaggcgcgccgcaagggggcgctgctggcctcggggcatctgctcggcctgctctaccaggacccggaggcgtggttcaagggcaccggcgctgccgatggcccctccgacgccgagatcgaggcggccatcaccgcccgtgccgaggcccgcaagtcccggaacttcgccgaggccgaccgcatccgccaggatctggcggccaggggcgtggtcctcgaggatggggccggcggcaccacctggaagcggggctagccccatggccagggtgccgctcacgggtcggaagctggcgtatcacgccctgaccttcgtgttggtggtgctgctgctgatggcgccggccctgtggaacggctatccgctggtctatttcgacagcgaggattacgtcgagatggcgttctccttccagccgatcatctggcgcatcatgacctatggcatgttctgctccatcgcccggttcttcgggacgctgtgggcgctgcccctggtgcatgccatcctcaccacctgggtgctgcacgaggcggtgatgggcttcatcggccgctggcggcacatggtgttcctgggggtggggctggcgctggccctgttcaccggcctgccctgggtgtcgtcgcaattgctggccgacgtcttcgccggagtggccattctcggcatcgccgccctggccttcggcgagggcctccagccctggcgccggttcgccctggtggtgatcaccgccatcgccatctgcgtccatatgagccatgtggcggtggccgccggcctgttgctggtcctggtgacggtgtggctgggctcacgcttcatgctgcgcatgcccaggccgcgcctgaccgcgccggtcatggccatcgtggcgggaatcctgctggtgccggtgacccattatttcatcatgggccgcttcgtcttttccgaatcgggccaggtgctgcaactggccctgctggtccagaacggcatggccaagaaatacctcgacgaggtctgccccaagggcgccgacctggagatgtgcgaccacaaggacgagttgccccataccgccgacgaattcctgtggggggattcccccttcgacgagatgggcggctggaaggccctgcacgacgaggcggggcagatcgtctcgggcgccatccggctgtttcccgccgacatgctgaactcggccctggccaatacctgggaacagctgaactccatcgagagcggcgaggatctggtgcccatgacctggcacttcgtgcgcacccagttgcggcgctatcccgacgagttcaggcagttccgctttgcccggcagcagcggcgcccggccatcgacttcttcaccatcaattccttccagatccccatcaactggggggcggaacttctgacgcccattctgctggtggtggcctggcgccgccgcgaccgcaccaccaccgggctggccatcatcgtggtggcggccatcatcggcaacgccatcgtctgcggcgctctgtccaatccccacgaccgctaccagaaccgggtggtgtggctggccttgttcaccgccatggtgggggcggtgcgcctcgaccagcgcttcgccggacagcggcgcctttccatccgcgccgagaacgaggccctggccgccgaggcggccgagggcaagacgcctccggcctgacccgttcggaggcacagcctccgaccctccagtttccaaaagctgaaggggccgggaagctgtgcttcccggttgggggatcgggggcgaacgcccccgaattgggggttagaccagctccagcaccatctcgaccacgtcggggtcctcgtccgacgggtgcttcttgaagccggccttggcggcgaggcggatcatggcgtcgttctctatcatgatctgggcgtagatggcccgggtcttgcgcgctcgctgatagcggacgatcttgtccatcagcatgctgcccaggccggtgcccttcatgtccgagcgcaccagcaccgccagttccgcccgccggttgtcggggtcggtgacggtgcggaccacgcccagggtctcgggggtgccgtccttgttggcgcgggtggcgatgaaggccatctcgcgctcgtaatcgatctgggtgaggcgcgccatctggtgatgatggatctgccgcacctgtccgaagaatcgcagccgcaggtcctgaggcgtcatgcggcccatcatctcggaatgggcgacggtgtcctcgggccggatggggcgcagggtgacgggcgagccgtcgtgcagcctggcgctttcttccagctcggcaggatagggcaggatggagaagtggcgcaggtcggtgtcttcccacggcgccacccggatgcgggcgtccaccgccagggcaccatgctcgtcggcgaatagcgggttgatgtcgcaggcgacgatctcgggattgtcggccagcatgcgcgacacccgcaccagcacctcggccaccgcgtccacgtccacggcggggcgccgtccatgggcctgcagcaggcgcgacacccgggtgcggccgatcatgccgcgggccaggggcaggttgacggggggaagccccaccgtgtggtcgcggatcacttccaccgcccggccgccctcgccgaacaccagcacggggccgaacagggcgtcgcaggccacgccgacgatcaattgccgggcattggggcggaaggccatgcgctggatggtgaagccgtccaccttgatgtcgggacgggtctcggtgacgcggcgcaggatgccctcggccgccgagcgcaccgccgccccgtcttccaggttcagcgccacgccgcccacatcccatttgcgggccacgtcgggcgaggcgatggtcaacgccacgggatagcccaccgcctcggcggcggccacggcgccgtccacgtcgggggcgaggcgggtgtcctgggtcttgatgccataggccgacagcagggccttggcgtcgggctcggtgaggttgccgcccgcctcggcaaggccgcgcccgacgatgaggcgcgccgtgcccttggccgccgcgaagccgcccagttgcgagggcggcgtctccatcagcatgtcctggttgcgctggtaattgaccagatggcgaaaggcccgcacggcgcggccgggggtgtcgtaggtgggcagggcggcttcggcgaacagcttgcgggcgggggcggcggcctcctcgcccacccaggaggtgagcaccgcgccgccatggcgcttctgcacgtcgatcaccgcctgggcggcctccagcccgtcggccatggcgttgggggcgtgaaccaccagggtggcgtccacctcctcggcctcgatcagcacgcgggccatgtcggcatagcgcttgccggcggcgtcgacgcccaggtccaccggattgcccgccttccagccgcgcggcatcagggcggccagcttgcgcagggtttcctcggacagcgtggccatctggccgccgccggggccgcccatctcggccagggccatcatggcggtgccgccgccgttggacagcacggccaggcgctggcccttcatgggcttggcccgcgccagggtctccaccgcgccgaacagctcgtcgatgtcgtgcacgcgcagcgcaccggcccggcggatggcggcgtcgaaggcatcctcgggccgggccagggattcggccaggaacttgcccaccggatggtcgtcggcctcgggcacggcgcgcaccaacagcaccggcttgttgcgggcggcggcccgggcggcggggatgaagttgcgccgcgccccgatggattcgatgtacagcaggatggcccgggtctggtcgtcattggccagatagtccatcacatcggcgaaatcgatgtcgtgggcgtcgcccaggctgatgaagtgggagaacccgatgccgcgtggccgggcccagtccagcacggcggtggacagcgcccccgattgcgacacgaaggccaccttgccgggaagggccggcacatgggagaagctggcgtccaggcggatgcgcggcaccagcaggcccagcgcgccgccgcccaggatgcgcaaggaccagggccgcgccgccgccagcatggcctccttgtccacatcgccggcgatgaccaccgccgcccgggtgcctcgccgccccagatcctcgatcaggccgggaatggtctcgcccggcgtgcacagcaccgccagatccggcgtcaacggcatggaccgcacgtcgggataggccaggacgccggcgatggcgcggtgcttggggtgcaccggcatgatggggcccttgaacccggcggtcagcaggttgcgcatgaccacggcgcccgccgagcgcggccggtccgaggctccgatcaccgccaccgaagtgggctcgaacaggaaggaaaggttgtgaatgctcatgggagtcgagtttctgccgcactgcggaaaatgcaagggagaagtggggtttttctcctcgcttcccgctgggctccgcatggtctatggtgcgccgcttaaaggggttcgccgtattttcggggttgtatccagatgctgagaatggctgttgccgccgtggttgtttctcttggctgcggcctgccggccctggccgccgacgaagggcaggggccgatgccgctggtccagcccctgccggccgcccccgccgccccggccgaggagacccccggctttcaagcggtgcgcccgctggccggcgccgaggctcctgccgccgctcccgcttccgttgctgctccggccccggctccggctccggttgccgctccggttgccgctccggccccgcttcccgtcgctccggtgatggcgccgccgccgccgccgcctgcgccgcccgccgccgtgacggctgagtccggaatgcccgctctgctggtccaggccggagtggcggcgctgatgatcgtcatcggtgccctggttgccgggctggtgggcaacgccaccgccgccgccggccgccggcgcgaggaggccatccgccgcaaatccgccgccgccaccctggtgatcgagctggaagcccgtatccaggccttcgaggccgtgccggtgccgcccaatgccgatgccggcgtgtccttcgtctccgccacggtggccttggccgacctggattacggctggaaggcggtccaaggcgcgctgtacctgctgcccgagcgtctggccggacatctggcggtgcattacgccgccgtgcaccacgtggccaagttcatcaagggccagtccttcgccgccggcctgcgcatgctgcaggccaaccgcatcggcggccatccctgtcccgacgccggcatcatgcgcgaagcccatgtggagctggccgccgccttccgcggcgtggacaagatcgtcatgggcctgaagtccatttcgtaacacctcgccttccggcgtggccggccaccccggcgccttcgggctgggccacaaataagcaaaccagtaccgaaatgcataaaaccattcccgcctgggacaatggtgccgccggtcaattgttcccggcggagaatagccctgacgaaagtgatgctttcatgattcaagtgttgccgcacttgccatgcgatgcatcgggaattggcgtggtccgtcgccgctgatccaaagtttttgtggttatttcaatgatattgctgcggcgcgtcggcgtcctgcggggcatcatatgatacaaaacttttgacagatactgtgtctgtgtaatataacggaggaaatcaaggggcgccgaaacaggccgcatccgccaagcatccgggaggattttcacatgaagagcacgctggtcgccggtctgaccgccacccgccgttacgaggtcgacaagggtcgcaccatcggtttcatgggcgacgaggcgcgggtctacaacaccccggcgctgatctacgacatggaggtcaccgcccgcgacctgctgctggagcattccgatgccggcgaggattcggtggggacccgggtcgaggtcgatcatctggcccccaccctgctgggccagtgggtggagatcaccgtgaccatcgaagaggtcaagggccccggcgtgactttctcgttcaccgccaaggactccctcgacaatatcggcaagggcgtgcacaagcgcttcgtggtcggtgtggaacagaccaaggcccgcctgctggccaaggccgaaaaggccaagagcgcatcatgagcgccgccccggccgggggtggggggaagaaggtcgagaaggttcagacgtactgctaccagtgtgtggcgggccctgacctgatgaccgtcaaggtggtcgacggcgtcgccaccgaaatcgagcccaatttcaaggcggccgatacccacccggccgagggcaaggtctgcgtcaaggcgttcgggctgattcagaagtcctacacgccgcaccgcatcctgacgcccatgaagcggaccaaccccaagaagggcaaggaccaggaccccggcttcgtgcccatctcgtgggacgaggccatgggcaccatcgccgagcggctgaacgccatccgcgccgaaggtctgctcgacgcccagggctatcccaaattcgccgcctcgttcggcggggccggcacgccgacccagtacatgggctcgctcaccgcctttctgtcggcctggggtcccatcgacttcggcttcggctcgggccagggcgtcaagtgctatcactccgagcatctctacggcgagttctggcatcgcggctatgtgatcacccccgacacgccgcgcgccaattacatcatctcctgcggcaccaataccgaggcctcctcgggggtctgcggcgtctatcgccatgccgaggccagggcccggggcgccatccgcgtccaggtcgagccccatctgtcggtgaccggcgcctgctcggccgagtggctgcccatcaagcccaagaccgacgccgccttcctgatgaccctgctgaacgtcctggtcttcgaggccccgcgcgagcgcctggacctggacttcctgaggaacaccacgtcgagcccctatctggtcggccccgacggctggtatctgcgcgatcccgaaacccacaagccgctgctgtgggacgagaagaccgggcgcgccgtgccccacgacactcccggcgcggttcccgccctcgaaggccgcttcaccgtgcccaaggcggtgaccctgggtgccgacgaggatcgctgggaacacacggatgtggaaggcgtcaccgccttcaccaaattcatcgagcatgtgaagggctataccccggcttggggcgccaaggtctgcgacgtgcccgaggcgcgcatccgcaagatcgccaatgatttcctcgaccatgcctgcgtcggccagaccatcgagatcgacgggcaggtgatgccctaccgtccggtggcggtggtgctgggcaagacggtcaacaacggctggggcggcgccgagtgctgctgggccaggaccatgctggcggtgctggtcggcgcgctggaagtgcccggcggcacggtgggcaccaccatccgcatcaaccgcccggccgccaaccgactggaaagcttcgagggctgcctcgacggcttcatggaataccccttcaaccccaccgacaaggacacctggaaggccaatccgatcatccggaacgcctacaagatgctggtgccgctggtgggcaattcgtcctggagtccggccctggggccgacccagttctcctacatgttcctggacgagccccaggaccagattccgcgcgccaccttcccggaattcctgctggtctaccgcaccaatccggtgatctcgttctgggataccgaccgggtggccagcgtggtgtcgcgcatgcccttcgtggtgtgcttcgcccatacaagggacgagaccaaccacttcgccgacatcctgctgcccgacgccaccgatctggaaggcatgcagttgatccgcatcggcggcaccaagttccaggagcagttctggaagcagcagggtttcgccctgcgccagcccagcgtcaagccccagggcgaggcccgcgacttcaccgacatcgccaccgatctggcggtgcgcaccgggcttcaggaaaagtacgtggccgccatcaaccgcggctcccacggcgtgccgctgaagggtcccaactgggatttcagcctgccggtggacaaggctccgagtttggaggaggtctgggacgcgtcgtgccgttcggcctcggccgaactgagcgacggcgccgaatcccagggtctcgactggtggaaggaaaacgggttccgcaccattcccttctccgagaccaactggttcctgactccggcgctgaaggccaagggcctgcgctatgagctgccctaccaggagcgcctgacccgcatcggccgccagttggccaaccgcctgaaggaggccgggatcacctggtgggatcaccagctgaccgaataccggccgctgatggaatggcacgacttccccggctattgggaacagagcgtggtggagcacggcggcaaggtggcggacttccccttctgggtggtcacggcgcgaagcatgcaatacgcctggggctccaacatgcacattccgctgatgcgcgaggtgtcgggccacatcaagggccatgacggcgtggtgatgaaccccgaagctgcccgcaaggtcggcgtcaaggagggcgagcgcatcgtcgtcaccgcgcccaccggcaagagcgtcgccggccgcgtggtgctctcccagggcattcgccccgacaccattttgatgatgagccagttcgaccactgggccacgccgatcgccaaggatttcgacgtgcccagcatgaaccggctgaccgccatgaccatgcagttgaccgacgccaccggctcggccgccgatctgtcgcgcgtcgccatccgcaaggcgcgagccgacgagcaggggaggcggtcatgaccaaatgggccatcgtcgccgatctggggcgctgcgtcggctgccagacctgcaccaccgcgtgtcgccacgccaatgccacgccgcccggcgtgcagtaccgcaaggtgctggacatggaggtgggcaccttccccgatgtgcgccgcgtcttcgtgccggtgggctgcatgcattgcgacgagccgccgtgccgcgacgtctgccccaccacggccaccaccaagcgcgccgacggcatggtgatgatcgactacgacatctgcatcggctgcggctattgcatcgtcgcctgtccctatcaggcccgctacaaggtgtccaagcccaccttcgccttcaaggatcaggagacgcagaacgagcggacgcgcttcgatgagcgcttgcttggcgtcgcgcagaagtgcaccttctgcgtcgaccgggtcgattacgggctggccaacgggttgacccccggggtggcgccggaagcgactcccgcctgcgtcaattcctgcctgtccaaggcgttgacgttcggcgacaccgataatcctgacagcaacgtcagcaagctgctgaagcggtacaagtcgttccgcatgcacgaggaactcgggaccggtcccaacattcactatttgtgggagaccgaggacgaatgagcgaggaattcgaagacgccccggccatgcgccatcaaggcctgtcgccctggctgcagaccgcctgggatctgcgcgccgccggcaacttcatcggcgggggctcgggcaccggcctcttgatcatcgcctcgctgggagccttcgacgggctttacagccgggtgctgctgatcgccggactggccctggtcggcctcggcctgttttccgtgttcctggagatcggccgtccgcttcgcgccctgaacgtcctcctgggcgccaagcgcagctggatgacgcgggaagccatggtggccgccgtgctgttcccgctgggcgccgccgcgctgatctggcccgatctgaccaagctggtgtggattcccgccgccgcctatctctattgccaggcccgcattcttgaggccgccaagggcattcccacctggcgctcgcccctgatcctgccgctgaccatcgccagcggtctggccgagggcgccggaatcctgctgctgctgggtaccctggcgctggagggcggcgcgccggaatgggtggctgggaccctggtggccaccatcgccgcccgcatcttcgtgtggatgttctaccgccgccgcatggtggggggcgaggctcccgtcgaggcggcggctgtgctgatccgcttctccatgccctttaccctgggcggcaacgtcattcccatcgccttcctggtgctggccggcattcagcccgacatccgcgccgccgccctggccgccgccgggctggccgccatggcgggcggctgggccatgaaggtggtcatcgtcaccaaggcggcccacaaccagggcttcgccatcaaccattctcccgcccgcggcggcggggagtccggacccggtttcaagccgggctggcgcgaagtgccgaaggacaagaagtaagaccgcacggtcagtgatgtgatctttatcgggctctcgcccgaacccagttggggccaggccccaaaccccctttattttcgaaaataagggaggtttggaggtctcctccaaccggggccggggcgggagccccgtcacatcggcgtccgggcggacaaaaaatcgcccggccggtgaatgccgatccgagagcgaataaaagcgaggagaggcttcatgggcaatggtttggaaccggcggcgctgggcgtcgtggcgggcggtagcggcgacgacctgcgggtcgggctggtcaacacccgcgaattcggcatggtcatctcggcggggctgggggcaagcgacgccgccctggccggaggcgtgttcgccaaggaccgcgccgtggtgcatgcctcggtggaactgaccgacggcgcggcttttctgacgcgcttcaagcggaccttcgcctatcaacgcctcgccgcccgggggctggcccccgacgcggcgctggaaaagtgcttcgccgccctgatcgacctgggccgctccgaggcgggccggaccatcggcgaggtcacccttgatctggcggtgaaggacgccgccctggtcggggccgtttcctccaaaccctgcgcaccggcgcccacgcgtctggcccgccccattgccaagatcgacaagctgatccatccggaaaagatcggcatcgtcggcgtctcggcctcgggcatgaatttcggccgcatcatcctcaagaacctgatgggcagcggctgtcccccggagcggctggtgatcatccgccccgaggaaagcgagatcgacggggtcaagtgcgtcgccagcctcgccgacctgccggccaagctggacctgctgatcgtcgcggtgccgtcgggcgccgtctatcccctggtggacgagatcatcgccacggacaaggtccattcggtgatgctgatccccggcggcctgggtgagaccgaggccagcgtcgagccggcggccgccctggcggcccgcatcaacgccgcccacggccggggcgacggcggcccggtgttcctgggcgccaattgcctgggcgtggtcagccatcccggcggctacgattcctggttcatcccgctggagcgtctgcccaagccggccaagaaggccaagcgcaactcggtgctgctgagccaaagcggcgccttcatgatcacccggatcagccgcaatccctggctggaccccgcctatatgctggcgctgggcaaccagaccgacctgacccacggcgacatgctgacctatttcgccgcccgcgacgacatcgagaccatcggcatctatgtggagggcttcaaggacggcgacggtctggacttcgtccgtgccgtgcgcaaggcggtggcctccggcaagcaggtggtggtctacaagtcgggccgcaccgaggccggggcggcgggcgtcatgggccacaccgcctcggtggccggcgaccccgtcctgttcgaatcggtggtgcgtcaggccggtgccatggtggccgaggacgtggacaccttcgacgacctgttctacatcgccggcgccttccaccataagaccgtgggcggcaaccgggtgggcggcatttcgggcgccgggttcgaggcggtgggcatcgccgattccacggtgaccgagaccttccgcctggagatgggccagctttcccccgacaccgtcgccaaggtgcaggagatcctggtggccaagaagctggactcgctggtgaccgtccgcaactccatcgacatcaatcccggcgccgacgacgagtgtcatctggccatcaccgaggccttcgcccaggaccccaatatcgacgcggtggtggtgggcatggaccccaccgcgccgtcggtgatggcgctcgacgccagcaagctgcgccccggctgggacatccacaatcccaagagcagccttcacctgttcccgcccatcgtcgagcgcaacgacaagcccatcatcgccatcgtcgacggcgggccgctttatgacgccatggcgggagggctgatggacaagggcgtctgcgtcttccgcaactgcatgcgcggcacaagggcgctggcccgctatgtcgaggcccggctttacgccgcgacgctgcgggggtagggctctctccccaatcctcccccggcaagcccgggggagggagcttttctccaaccaagtcgggggggggcttgccgccgccctatcagcgggatagatagaggccctcaagcggaagggagggaccggccatgttcatgtttgcccccgaggtggagcgtctggaccgtcccgccctcaaggctttgcagttgcagcggctgcgcgacctgctgtcccatgcctatgcccatgtcccccatacccgcgccgccttcgacgccgccgggatcaagcccgacgatctgcggcatctggaggatctggcccgctttcccttcacggtgaaggcggatctgcgcgacaactaccccttcggcctgttcgcggtgccccgggagaaggtggtgcgcctgcatgccagctccggcaccaccgggcggcccaccgtggtgggctacacccaggccgatatcgacatctgggccgggctgatggcccgctccctggccgccaccggcatccgtcccggtgacgtggtgcacaacgcctatggctacggcctgttcaccggcgggctgggctttcactatggcgccgagcgcctgggctgctcggtggtgcccatgtcggggggcaatacggaaaagcagatcggcctgatcagcgatttcggcgcccgcgccctggccgccacgccgtcctacgccctgaacatcgccgaagtggccgagcagatgggcgtcagcctggccgaatcccccctggcggttggcgtgttcggcgccgagccgtggagcgagtccatgcgggccgaactggaccggcggctgggcatcaaggcctgcgacatgtacggcctgtccgaaatcatggggccgggcgtggccatcgagtgcgagcaccgggtgggtctgcacggctgggaagaccatttcctgttcgaggtcgtcgatcccgagaccctggagccgctgcccatgggggccgaaggcgaactggtcatcaccacgttgaccaagcaggccctgcccatggtgcgctaccgcacccgcgacatcacccggctgaccgacgagccctgcgcctgtggccgcacccatctgcgcatcctgcgggtcaccggccgcaacgacgacatgatgatcatccggggcgtcaacgtctatcccagccagatcgaggcggcgctggtcggctttgccggcgtggcgccccactatcagctgaccctgacccgccagggctcgctcgaccacctgacggtggaggccgaggtggaggacagtcggggcgaggacgaccgcgcccatctggcccgtcaggtccgccaccacctcaaatccctggtcggcatttcctgcgaggtgatcgtccgcctgcccggcgagctgccgcgctcgcagggtaaggcggtgcgggtccgggacctgcgcaagcaggcggagtagtcagtaccgcccgaacaccttggttccttcggggccgaagctgtggaccacgttgtcctccttcggtccccccattccgggcgagcccatgggcatgccgggcgaggcgatgcctcgcgtccggggcttttccgtcagcaggcggtccaccgcctcggcggggacatgaccctccagcagatagccgtccaccttggcggtgtggcaggactgcaggggggcgggaatgccgtaggcccgcttgatctggtcgatgtcgtccacgtccacggacttcaccttgtagccggattggcgcatatgctcggcccagccttcgcaacagccgcaggtgggggacttccacatggtcacctcgcgctcggcggccaaggccggcagggtggcgaacagggcgaacaggaaaacggcgacggtcttcatggctggttctccctcaatgtccgtgtccggcatggggatcggccgccgccgtcgccggcgctccccccaggccgttggccgcctgcacggcgcggatataggccagcacctccttgtcctggccgggcttcagtccctggggcttgggcatgtcgccgaacttccacatatgggccttggcgccgtcgttcatggccgccaggatcacgtcgtcgccatgggccgagcccagggcgtagaagggatgcagcaggggcgggccattgtcggtgccgcgcaaggctcctccatggcaggtggcgcacaccgcctcgaaggtcttgcggcccgcctcggccgggccactgacggtgggagccaccatctcggcctgctggaagcgcaccgagaccggcttgccgtccaccaccaggcccagcacggcggccagcttgtccttggctttgaccggcaccggggcggtcagaccgtcgtccttggcggccaggtcggcctccagcttctggccgttcagcagcagggtggccttgcccgaggccttcaccggcttgtcgtcgtgatcgcgcagccagacgcggatggcgccgtcgcgcacggcgaattcggcgcggtagtcgccgctctcggcgatctggccgccgaaaaaggcgaccatggtgccgtgggccagggccgagggcaccaccagcagcagggccagggtgagaaggcgtgtcttcatggtcgaaatctccttgggcgcggtcacggccgcgcttcggttgcgaggttggtcaaggccttgcggccgatcagcaggaccaccgccggggtgaccagggtgtccagaagggtcgatgacatcaggccgccgaagatcaccaccgccaccgggtgaaggatctccttgcccggctcgcccccggccaggaccaggggcagcagggccagggcggccaccagggcggtcatcagcaccggcgtcaggcgctccagcgagccgcgaaggatcatggcggggccgaaatcctcgccttcgtggcgcatcaggtggaggtagtgggtgatcttcatgatgccgttccgggacgcgatgccggccagggtgacgaagcccaccatgcccgccaccgacagcggcaggcccgacagccacagcgcgccgacgctgcccaccagggccatggggatattggccatgatcaccagggccagcaggcccgagcggaaatgggcgtgcagcagggcgaagatggcccccagcgacaccagggccagcaggccgatcaggcgggtggcctcctggcggctctggaattggccttcataggcgatggcgtagccggggggcagggtcatgccgcccagttccgcctgcaattcctccatgatggcgcccaggtcgcggccctgggaattggcgaagaccaccacccggcggcgcagattgtcgcggttgatcaggttggggccttgggtctccaccacctcggccaccagggacagcggcaccttgcccgccggggtgtccaccaggatctggcggaagtccgaggtctgggcccgccagtcctcggccaggcgcagcaccagattggtcgtgcgctcgccgtctctgacctgggacaccaccttgccctgcagggcggcttccagggtctcggtcaactggccgaggcccaggccgtatttgcgcgcctcggcccggtccagccggatctgtacctgggggatgaggaccagcttctccacctggagatcggcgatgcccctgacgccctgcatgcgggtccgggcctcggcggccagactgcgcagcgtgtcgagatcgtcgccgaagatcttgacggcgatctcggcccgcactcccgacagcaggtggtcgaggcggtgcgagatgggctggccgatattgatgttgatgccgggtatctgggcgaggcgcgcgcgcaggtcgcccaggatggcgtcacgcgggcgttggctgggatgcaggtccacgtcgatctcggagtagtggacgccctcggcgtgctcgtccagctcggcgcggcccgtccgccgcccggtggaggcggcctcgggcacctgccggatcagcgtctcggcgatggtgccgatgcggttggattccgacagcgaggtgccgggtggcagcaccacggtcaccgtgacggtgccctcgttgaagctgggcaggaaggtgcggcccaggaagggcaccgaggccgccgccaggatcatcagggccagggcgggaaggatcaccgccttcggattggcgaaggatcgctccagcaggatgcggtcccaggccttgaggcggcgcaccagggcggaatcgccgtggcccatgaccctggcccggggcagcagcagcagcgacaaggcgggcgtcacggtcagcgacaccgccagcgaggccaggatggagaccacataggcgatgccgaggggcgcgaacagccggccctcgatgcccgacagggcgaagaggggcaggaaggccagcaccaccaccatggtggcgtagacgatggagttgcgcacctcggacgaggcgcttcgcaccacctcaagcaccgggcgcggctgggccgtggcggcattctcgcgcaggcgccgcaggatgttctccacatccaccaccgcgtcgtccaccaactcgccgatggccaccgccagaccgcccagggtcatggtgttgatggacagattcatggcgtggaacaccagggcggccaccaccatggacagcggaatggcggtcaggctgatgacggtggtgcgcatgttcatcaggaaggcgaacagcacgatggccaccagcacggcgccgtccctcagcgcctcggccacgttggccacggcgcgggagatgaagtcggcctgacggaacagcacccggtcggcctcgatgtcggcgggcagcgtccgcccgatctcggccagggcggcttccaccttgcgggtcagcgtcaccgtgtcggcgccgggctgcttggacaccgccaggatcaccgccggctggccgtcgatggcggcgtcgccgcgccggattcctgcgccgtttctgacctcggccacctgatccacggtgaccggggcgttgttgcgccacgccaccacggtgttgcgcagatcgttcagatcggtggtctggcccatgttgcggatcaggaactcggccgagcgctgttccagaaatccgccggtggtgttgcgggcgaagccggccagggctttttccacatcggcatagcccaggcccagggccgacatgcgcgacggcgagaccagcacctggatctggcgcacctcgccgcccatggggatcacctgggcgatgccgggaatggagagcaatcgggggcgtaagctccaatcggccagggagcgcagctccatgggcgaggtggcgccggccttggagcgcacgccgaccagcatgatctcgcccatgatggagctgaccggacccatgacgggattgatccccgccggcagcaggtcgcgggccgaggatagacgctcggccaccaattgccggttgcggtagatgtcggtgccccagtcgaactccacgaagacgatggacaggcccacgccggaattggaccggacccgcaccacgccgggggcgccgttcatggcggtctcgatgtggcaggtgaccaggctttccgattcctcgggggccagccccagcgcctcggtcatgatggtgacggtggggcggttgagatctggaaagatgtcgatgggcagccgagccagcaccagcgagccatagacggtcagcgccagggcggcggccaggacgaacagccggtgacgcaggctgagagcgatgatggaatcgaacatgatcgctacctcagcgctttcagttgctcgacgccctggatcaccaccttttcgcccgtcttgacgccctcgatctcggccagggggccgaccatccgctcgacgcggatggggcgggcctcgaaggtctcgggcgcggcgcgcacgaacaccacctgacggccgccgaactcggcgatggccgagcgcggcaccgccatgcgcagcctcgttgctccggtggccaggaagacgtccaccggcatgccgatgcgcaaggtgcgggcctgggcctcggacacggcgaagatggcgtgcacgccctggtccagggcatcgacccggggactgacccccagcagggacagcgccaccgcctgatcgggcagtactttggtggcggcggtggcggcgccgatgcggcccgccagcgccagatcgtgaatcaccgcctcgacccgcacccgggtcgggtcgacgatctcgatcatggccttgtccaccggcaccacctcgccggggaccacatgcacgtcggtgaccacgccgtcgatgggggcgcgcaccagttcgcggcccagggcggtgcccagaagctgggagcgctcgcgccgcagctggtccaggcgggtgcgggtgtcctccaccagcttggtggccaccagtcccttcagcgcttcctggcgagaggattcccgctcggtgatggcgatctcgctttccacccggtacaggctggcccgcttgtccgagcgctccagggtcgacagcgtcggttccagcactccgatcacctggccgcgcttgacgccttggccggggacgggcagggggaattcagggtccgagacgatgcgggccggctgcgacggctgcacccgggcgaaaccggcgggatcgggcaccacgcggcccaccacccggacggtctcggcggattcggcggaatccaccttctgggtgcggatgcccagcaggaactgggtgggcttggccatcaccagcagggcgccgggctgggcggcgggggtctccgccgtggcggcgtggtcgtgaccctcatgcgcccgcgcggcgggtaccgccagcaccagcagcagcacggccgttcccgccccgcgccgccccagcagccaggcggcgaccaccagcacggcgccgatggcggcaccgccggtccagtggcgccaatgctccactggggcgggcggggtggcgggcggcggcaagggcgccacgccccgggccagcagcaggtcgtcgcgcccctgggcactgatcaccagggtgaggtcggctccggcggtggggggcgcccaggccagggcataggcgcccggcccctcggccggtaccgccttgccgctccagccttcggcctcggcatcgatggcggcgccggcgacgggggcgttgccgtccaggtcggcgagataaagcaaagtgcggccatcggtgccgggaaccagcaccacctggaagacgtcgccctcggcgccgatgccgggtgtcgccggctgggcggcccagacggatggaatgagcgcggcccaaaaggccagcgccaggaagcgtgcaaacatgggaagtgatccccgaaacagtgaatccggacggacttcaggcgtgcggaatcagagtctgggaggttcggcgggcggtccgctctgcgcctgggtcaccaggcgggtgggggccggagccaggggcggggccacggtgaaggtcacgggggcttccccggccattccgggcaaggcggccgcagcggaagcgcagcccgagaacaggcagcagcctttgtcggccttcttgtggtgctctggaaccggagcgtcgtcgtgaccctgctggtggcagggcacggccccatcggcgtgcatggcatgagcgctgccgtgctccatgtcctcggccgcctgggctccgccattccacgccaaaagcccgaccgccagcagcaatgccggcaggccaagtctcaacagacgggaaaggacggtgctcatggcttcactatgggggaattcttgatgaaagggcaaggggcttgcggcgggcctcgctatccttcggtataggaccttggatatttgggtgcgacagatccatgttaaggtggagtccttcgaactggtccggaaaaggcgtcatgcccgataagcaaggacacgaacggcggcgctatccccgtttccacggattgcagctgatggccaacatcggtggcaagctggtgcaggtggccgagatttccgccggcggcatgacgttggaggcgggtttcaagaccaccgccggcgcccttcgcttcaccttgtaccccagtgacaacggcaagctggacatcaatcacggcatcggcggccagtgccgcgtggtccgcgaggacgcgacattcgtggccctgcgttttgatccggccacctaccggctggtaaagttcatcgccgaatgctccgaggtggggcctgaaaaggattcctatctcggttaagaagcatctcagccgcagctttggatcgccgtgtgaaggcggtatcgtgtgtcgacgcaactcttagagaccgggcatggatgtctgtaacaaggtggaggccggtggtggcgagcgccgcggacgtgaccgccggcagtcggatatcgaggcggtgttgcggcggaccgaggccaagttttccacggttttccgcgcctgtcccgacctgatcgccatcacggctcggtcctcggggcgtttcatcgaggtgaacgacgccttcgaacgcatcatgggctggagcaagtccgaggtgatcggacgcacttcggccgatctggagacctgggaaagtcgggacgaacgcgaccgcatgctggccgcgctgggagagtcctcccggctcgagaatttcgaggtgcgctttcgccgcaagtcgggcgaagtgttcaccgcgctgatctccctcgaagccaccgatctgagcggcgagcccagcctgatcttcgtcgcccgcgacatcagcgagcgcaaggccgaggagatggtgctgcgccgcacggcagaggaactggagcgttccaacatggaactggagcgcttcgcctatgttgcggcccacgacctgctggaaccctgccgcaccatctgttccttcgcccagatgctggatcgaaaatatgccgacatcctcgacgacgaaggccgcgagtatctggacttcctggtgggcggagcgcttcgcatgcgcgaactgatccagggggtgctgggctactcccgtgccggcgtggcggcggcgcagatggtcgaggtggatctgggccgggcggcggccgaggtggtttccgacctgggcagcgccctccaggcccggggcggcggcgtcgaggtcgggcccttgcccgtcgtgcggggcgaccccgcccagctgcgccagttgctgggcaacctgatcggcaacggagtcaagttccacgccgagggtacctcgccccgggtccgggtgttctgcggcaatcgcgacggcgaatggtgcgtcaccgtcgaggacaacggcatcggcatcgcgccggaatatcaggacgacatcttcggcattttccggcggctgcacggcccggaccgctattccggcaccggaatcggtctggcggtggcgcggcgcatcgtcgatgcccatggcggccgcatctgggtcgaatccgagccgggctggggggcccggttccgctttaccctgccgatggtgtgaggtggcttcgcgggctgcgaaaagcccagcttcgcggctgggcgaccgcccaggcccgttcggaggcactgcctccgagccaccagctttttaaaaagctgaagggttcgggaagcgggcttcccgattgggggatcgggggcaaacgcccccgaaggtgagcccctggtgggcgcctcagcgccggctgtggcgccagctgtcggccagataaagcccgatggccgcccagatgcagccgaaggtgatcagatgggccgggccggggctctcgccataaaccaggaccgccagcaggaagtgcccggtgggggccaggtattggaaaaaacccagggtggcatagcgcaggcggctggcggcggcggcgaaccatagcagcggcagggcggtcaccggcccactggccagcagggcggcgcccagctccggcgatccccccaacagcggcgcgccctcggcgacccgccaggacagataggccacggccaggggcagcatcagccccgtctccaccgccaggccggtcagcggcgccaccggcagcttcttgcgcagcaggccgtagaccccgaaggttccggccagggtcagcgcggcccagggcgccgtgccggtgccgattgccagctcgacgatgccggccagggccaggccgaccgccacccattgcagtggccgcagccgctcgcccagcaccaccacgcccagcgcgacgttgaccaggggattgagaaagtagcccatgctggcttccagcacgttgccttctcccaccacgcggatgaagaccagccagttgacgctgatgcaggcggtcgaggcggccagcacggccagccggcggcccgaggccagcagcaccagcacctcgccccagcgccccgtccaggtcagcatgatcatgacggtcagcagcgaccagatcacccgataggccaggacctcggttggcggcacgctggccagcagcttccagaaggcgggaaacagtccccaggtgccgtagcacgccagggcgaacagcacgccccggcggtgctccgcgctcacggttcacaccggagcgcagaggaaaacggcgtcaatccgcgaccagggcctcgtccgggtcgtcggcccagtcgatgtccggcttcggggtgcgggcgatccatttttccagttccactacgtgttcccgctcttcctcggccatttcggcggccagggcccgaacctcggcatcgtcgctgccggcggcttcgtcggcatagaagcgatgaccccgcttctcgttgtccagggcgaagtccagggcgtgccaggcggtcatcatgtaatgggtgccgccgggagtgcccacttcgggcggctcgggcgtgttccagcggtattgccaggatttcagtttgggcaggtcgtggccggcggcccgcgccgccaccgacgccccatgcaggcgcgagaacttggccatctggcggaacagttcggcgacttcgaggttgtggtggacttccatggagtcggccaattcgtcgtaacgatccgccgcctcgttttccatggccaaagcatgggccaggaacagggctaccttggtggtcatgggcagtgtcctcctgcatgaaccgaggcgacgggtggcggcggcgcctcaaccgataccggcagtatgcccgaggttcgaaccctcggctatgccccttccgaaggtgagggcatgaccaaaaggggcaggggggtcagcgggactcgcgtcccttgaggtagaaggccaccgcctgggcgcgattgccgacgcccagcttgtcgtaaaggttcttcaggtggaacttcacggtgttgagtgaaatatccaattgccctgccatctgctggttggtcaggccgccggccagggcggccagcaactcgcgctcgcgcggggtcaggccggccagcgggtcgctggccagggaggacacgtcgatgaacggaaacaccatgcgcccggcggccacggcgatgatggtgtcgagcaattgctcgggcggttcgcgcttggagcagaacccggcggcgcccagcgtcatggcctggcgcggtacatcggggttggggctgccggtatagacgatcaggcggggggcatctacgcgggtccgcagggtctgcagaaccccgcgcccgtccaggtagggcatctcccacccaatgatacccacgtcgaagggggtcttttccacggcttcgataaagcgctcgccatcgctggtcaccgcggcgacggtgaagcggtcgtcgcccgagaacagcttaatcaggctgctttgcagcagcggattcttttcggcgatgacaatgacgatcggtcggctctgctgcacggccattgatcctgatccttccccccagaagtccctaggtccagcccctaggtcgagccatggaccccacccttctgaggccgtgatcttaccgtttgtgcaaaaaaccgcaaaccttgatcgagagttacccacacttttcctacaccacggcggggggcgggggccatccggtcaggtctttcccgcacggccaaaataaaggccggcagccctggcgggcgccggcctcttggaaaatgcaggtgctctaggcctgctcggcccaggcgcgggcgtcgaacttgccgagatcgctgtcggcggcgggggcgacgggcacggcggccggcatggcggcgggcgtctcggccggcacggcggccctggcttcgataaccttgtgggtctcgacggccttaggggcatggggcgcggcaggggcggcgatcacggcggccggagcctccaccatgctctccaccggggcggcaacggcggggcgcgacgcctcggcgcgaagcgaggcggggacgacggaattgcccgggcggtagacgaagccctgggtcttgtagacgcggctgccgtattcgcgggtcggctggtaccagacgcggacctggctccagtcattcttgggcgacacgtccatcacgggaacagccttggtcacctggccgcggccggcggtgcggtggggcgcccagttggcgtgatcgacgaggagcaggcggctgttggtggcgccgcgcaccaccgccacatggccgtgggacatggaaccctggcgcttgaagaccaggacggaaccgaccttgggagtattgccgcgctcatagacgccttcggcggcttcccaccatttccaggcgtcgcccttgagattgaggccggtcacttcgcgggcataggcaacgcactgaagcgtggcgttggcttcgaacggcagggccagcagcatcgacgccacaagcaggaagatcgcattgcgcaccggtatccctcccctccggtcattagcgaagccgattgtgtctatgtgaaaagccgatggcaacctgttttgtaaaattacatgcaaattatccgtactatccctgagtattgccgaaagtttgtgccgaagcgggcagggctttcggacttcgccttgcccggctatgatccgggcgaatcctggaggatgagcgagtgaagcgcatactgatcccggccctgatggccggattggctctggcccagacggccggggcggcggaacgccggaccctggtcatcgccgggggtgaggtcaccggctattactttccagtggccggcgcgctgtgtcgcgtgatcaacaaggaccatcccctggggctgggctgtgccgtgatgcccagttccggttcggcggcgaacctcaccgccctgaaggccggcgatgccgatctggccctggtgcagtcgcgtgccgcccagatggccgccatcggggccgaggggttcaaggaatccggccccatgagcgagttgcgggcgctgatggcgctgcatggcgaagtggcggtggtggtggcccgtccgggatcgggcatcgagaccctgggcgacctcaagggcaagcgggtcaatctcggcaagcccggctcgttccagcgctccatggcggagatggtgatcgatgcctcgggcctgtcccagggcgacctgtcggtcctggtggaactggacctgaccgagcaggcggcggaattgtgccagggcaatatcgacgccgccgtcttcaccggcattcatcccatgcccgaggtgcagatggcggtggaggaatgtggcgcctcgctggtgcagatccgctcgaaatccatggattccttcttcaagaaggtgccctgggcggcgcgcttcgccgtcaagagcggcacctatgacggccagaaggaggatgtggccgccatcgggttgaagacgctgctggtggccaccaagctgtccaccgaggaggtgacggccgtcgccaagaccctttgggcgaatttcggtgcgttgacccggcttcatcccgccttgaaaggcctttccaaggccgactccaagagcgacggcatccccatccgcctgcatgaaggggccgaggccgccgcggtggagcgttagggcgtgacgctggcccccggcaccctggcggcctgcatctccagccggagcgagttgctgcgcatcagggcggcgggtgagcgcctgcagaccctgacccgggacctggggggcgatcccacctccctgctgacccggggcggcggggtggaagcgttccgccactatcccaccggcgacgtctacgacctgtcgtcccacgcccagttctattatcacagccaccgggacggcgagttcggccacatccacctgttccagcgtccacgcggcatgccccggggacttgccccggcggcggccacgggggacgccgatgccccgtgccatctgatcgccgtggggttcggagcctggggcgatgcggtagagctgttcaccaccaatcgctgggtgacgggcgaggcctggtatcgggccgaggcggtcaaggccatggtggccggactgcgactggcgccatccggcccctgggccggggtcgccgggtggctggcggcgctggtcgccttctatgccccgctgatccgggtgctggtcgacgagcgcgaccagacggtggaggactggcgccgcacccatcccggccgcgacgaactggacgacgagcgcctggagatcacctcgtcccgggccatcgacccggccgctgatctggcgggtctttccccctgagggcgtcgcaacgagcgctttccaaataacaacgccgccgccccgttgccagggcggcggcgccgaaacccaagatcccgaagtcttacttcagggtcttcagataggcgaccacggcggccacgtcctcgggcttcttcaggccggcgaaggccatcttgttgccgggaatggtggccttggggtcggccaggtacttgcccaggttggcatcgtcccagaccatgcccgacttcacgtggttgtcggaatacttgtagccctcggcgtggccggccttggcgccgtagacgccgaacaggctggggccgacgccgtgcttgccggcttcgaccttgtgacaggccttgcactggttgaaagcggccggggcatcggcggcagaggcggcgaacggggcagcgaggagggcggctccgaggacgaggcccagcttcttggtgttgagcatcagaatctccaattgcgcaggtatggatgagtggcgcgatgcgtcccttatcccctaggattgtgtcgaattcaagaggctgagggcaagaatcggtccaggggcccatggtgcgatcgtataagtactaaaaatgcatgatttacccatcgagtccgtcatccccgaaatccgcgccggtttgaggcagtcccacggtttggtgctgcaggcgccgccgggggcgggcaagaccacccgcgtccccctggccctgctggacgagccctggctggcgggacagcgcatcctgatgctggagccgcggcggctggcggcacgggccgccgccacgcgcatggcgtcgaccctgggcgagcagccgggcgagacggtgggctggcgcatccgcttcgactcccgcgtcgggccgaagacccgcatcgaggtggtcaccgagggcatcctcaaccgcatgatccaggacgacccctccctggacggggtcggtctggtgatcttcgacgagttccacgagcgctcgctgttcgccgatctcggcctggccctggtcctggaaagccgccaggggttgcgcgacgacctcaagctggtggtgatgtcggcgaccctggacggcgagcccgtggcccggctgatgggcggcgcgccggtggtgaccagccagggccgcgcccatcccgtggagacccgcttcctggcccggcccgagcccagggctttcgtggacggagtggccgccgccgtgatccgtgccctggacgaggaggagggcgacattctggtcttcctgcccggcagcggggaaatccgccgggtcgagtccctgctggctgaccatccggcggcgcggggcgtgctgatcgcccccctttacggcgacctgtcgcaagacgcgcaggacggggccatccgcccgcgccgcgatggcggacgcaaggtggtgctggccaccgccatcgccgaaacctcgctgaccatcgagggggtgcgggtggtggtggatggcggccgcatgcggctggcacgctttgacccgggctcgggcatgacccggctggtcacgttgccggtgtcgcgtgccggggcggatcagcgccggggccgggccgggcgcttggggccgggggtgtgctaccgcctgtggtccgaggccgacgaccgcgccctgctgcccttcaccgcccccgaggtgaccgaggccgacctcgcccccctggcgctggatctggcccagtggggggtgaccgaggccctggacctgtcctggctcgacccgccgccggccgcccatctggcccaggcgcgcgaactgctgaccgagttgggggcgttggacgatggcttgcgcatcaccgcccacggcaaggccatggcgcggctgggcctgcatccccggctcgcccacatggtgttgaagggccgggacttgaggttgggcgggctggcctgcgatctggcggcgctgctggaggagcgcgacgtgctgcgtcccggccgcgatgcccgggattcggacatccgcctccggctcgacgccctgcgggggcgggagcggggattgccggtggacaagggcggcctggcccgtgcccgtcaggcggcgcgcgacggccgtcgccgcctggggctgaaggcgggcgagcaggagggcgacggccgcgacgccgggctgctgctggccttcgcctatcccgaccggctggcccggcggcgtccggggggcgagccgcgctatgccatgaccggcggcggcggagcggtgttcgcctcgcacgagcctttggccgccgaggaatggctggccctggccgagaccgacggcgaccggcgcgaggcccgcatcttcctggcggcgcccctgaccctggcggagatcgaggagcatttcggagcccagatccgatccgaaaccctctgtcgctgggatgggcgcgaagaggtggtgcaggcccgcgcccgccgggtgctgtggtccctggtcatcgaggacaagccgctgaaatccgccgagccggaggcgctttgcgccgccatggccgagggcgtgcgccagatggggccggcctgcctgccctggacgccggacctggagcggttgtgccgccgcgtcgccttcgtgcgcgggctggaccccgagggcggctggcccgatctgtccgaggccgccctgctggccgggctggaggactggctggtgccctatctttccggcatcacccggcgtgcccacctcgcccggctcgatctggcggcggcgctctcgggcctgctgtcctgggagcagaagaagcgcctggacgatctggcccccacccatgtggaggtgccgtcggggtcacgggtgcccatcgactattccggcgaggtgccggtgctggcggtgcggctgcaggagatgttcgcctgcgccgagacgccgcgcatcggtggcggcaaggtggctcttctgcttcatctgctgtcgcccgcccggcgacccatgcaggtgacccgggatctggccagcttctgggccaatacctacaagcaggtcaaggccgacctcaagggccagtaccccaagcactggtggcccgacgaccccatgcaggccgagcccacggcacggatcaagccgaggaaatagccccgttaccatcggttaccaaagggaggccgtctggacatctgcggcttacagtggggggctatggtccgcgatctcgataacctggaggatcgcagcgtgaatatccgtcgctccctgttgcgcgaagccgtggaagccgctctggtcctggccgccattggtgtcctggtggcctgcgccggccccggccgccccgacccggacgagcggcccgggcggatggcggcttcgattccggccctgctctacagtcccaatggcgagccgctgaccggcgggccgctgggcctgccatcgtgcaagctggccaccgaggtctggttcgagcgggccgacaccaatcacgacgggcggctggaccgcgaggagttcatggccgatgcccgtgcccagttccttcggatggatctggacgggcagggctatctgacctcggacgtgctggagcgctaccgcgacccttaccgccagcgaggccgtaccgcccaatcctctggaatcgatccggtgatgtcggccgaccggaactttcgcggcaaggtgacccgcgaggattttctggggcaggccaccgagaccttcgcccggcttgacgctgatcacgacggcgcgctggccaaggccgagttggagccgttatgcgccaacgccctgcagcgcgtccccgatcatcagccgccctcccaatccggggcgcccaatggcggcgggggaaaacggcggcatggcggcggatgggccggctagcgcttcctcgcccgcagtaccgtcaccagcatggtgacgatgaacagggcgatggccacggcgttgagcattccaccccactggcgcacggcatggatgtcggcgagatcgcccgccatcctcagccccagcgaggcgtgcagcgcggccagcggcaggtagaacaccggcttgtagggcaccgccacgcgcagcacggcgggcaggatgaccggggcgtgcccgaacaccatggcgaagacaaagccgacgaacagggcgtgcagcgcggcgtcgtagacgattccggtctcgcccggggaaaggcggagcatcaacagcccggcggccagggcccaggcatagccggacagcaggcacaccgccacatagcgggtcaggcccgcctgacggatggtgcgccggaccacgtcgttgaccaccgaccacagggtcagcagggcaaggcccgcgccgaacaccggccaggaccccaaccccattcccgccagcagcaccagcagcggcggcagcagggtgggggtgcgccagcgccagggcggcaggaagcgcgacagctccaggcgttcccccgcgatggtcagcaccaggaaggcggcccacagcggcaccgagccggccgcgtcgccgcccaggctccacagcaggttccccgccgcccatgccagcccccccaggcccagcacggtggtgaagatttcgcgctggcggaggatcaccgccagactcatggcgacgaagaccagactgccggccagcagcaggaccgcgccggcccagggatgcccggcgatcagggccacgccgcccagcgcggtgaacagcggcgagccatagccccaggccttgcccagggcgaccgcccgctccagcccgatcaccgtgccgaagaagccgcagatcatcagcggcccgtggaccagcgccagatcggcgccgcccaccggccagcccaggcggccttctccggcgatgatgccggccgccagggacaaggccccggccatcagcagcggcaggcggcgagccgtgacgctgatcatcccggccagcccatgatggacttggccgaggccgacatgcgcgacggctcccagaagggggagtcgagcacggcgacgctgacgcccaccgcgtccttggcggcggcgcgcaccacccgttcggattcatcgctgagataggcgctttgcgggcaggccggcgtggtcatgatcaggtccacatagatgccttccggcgcgatgcggatatcctccaccagccccaggtcgacgatgttgacgcccacatcggggtcgatgacctgtcgcagcgcctcgcggatatcgtcttgggtgagcatggaccaaagcctcctcttgctcggccaagactacccctgtcggcgtttcctgggcatgatggcggtcaagcgggcaggcggacgttgaagacgctgccgccgccctcggcgggttcgacccagatccgtccgcctgcccgctcgacgatcttcttgcagatggccagcccgatgccggtgccctcgaacttgtcgcgggtgtgcaggcgctggaagatgccaaagatgcgctccgagaattgcgggtcgatgcccaggccgttgtcgatgaccgaaaccacccatccctcgtcgtcgcgtcgggcggcgatgcggacgatgggggtccgctcggggtggtggtatttgagggcgttgccgatcagattctggaacaggcgcaccatgtcgtcgcgaaccagccccagcaccggcatctccgcggcgcgatccacctgggcgccgtgctcgacgatgacggtgcccaggttggcgatggcctcgtcgatgacgctgccgagattgacctgttgcaccgcctgcgaatgatggccgatgcgcgagaaatccagtaggtcgatgatcagccggtccatgcgcttggcgccttcgcgggcataggtgatatagtcccgggcgtcgtcgtccagggtggggccatagcggcgctccagcagggagacgaagctggccacctgccgcagcggctcgcgcaggtcgtggctggccacataggcgaactgttccaggtcggcattggagcgcgacagttcggtggcctgcgccttcagggcctgttccgaggccagccggtcgctgatgtcgcggaacatcagcacggcgcccttgacgccgccatcctccaccaggccggtggcgatcatctctaccgggaactgggtgccgttcagccgccagaacgtctcgccctgcacttcgcgggtctggccgtcggccagggtatgggcgatggggcattcgctgccgggataggcggcgccgtccgggcggctgtgatggttggccgcatgcaggtttcggccgatggggtcctcatgcagccagcccagcatggagcgcgccgccggattcatgaaggtgacccggccctggatatcgatgccgcaaatcccttcgccggcggcggccaggatcagctcggcctcgcgcttggcgcgttcggtggccttctgggccttctcctcggccttcatggcccggatcaggatcagggccagcaggccgatggccagggtgaccagtccggcgatggccaccagggtggctgtctcgcggcgccagggagccagcaggtcgtcgattccggcggtgacgatgacgatcaggggatagtcgcgcagcctctgatacgacaccagccgctccttgccgtcgatgaactggctggaggagcggaagacccccttgagcgacagggcgtagttgtcgcggaacgacggcgtgtcggcgatgttgagcccggccacgtggtcctcggacgggacccggaacaagaaggtgccatcggcccgaagcacggcgatggagccgtgcggcttgatgcgttcggcctcgaaggtcttgacgatgcggtccagttcgatggcgccgaacagcacggcgatgtcgccgccgttccggtcggccgggatggagaccgggatgccccacttgcccgtcacccggctgaccaccggattgccgatgtagaagccgcgggtctccatacgcgcctgggctttgaaatagtcgcggtcggacacgtcggcgagcggcttggggccgcgccaggggatgtagtgcaggccgcccgtgcttgtgaccatgcggatgtcaagcatgccgtcggacatctggcgcaggcggtcgaccagggtgatgaaggcgggattgccgcccgggctctgttgcggatgatcggccagccagtgattgctgaccaccagcgacgtctcggcatggcggaacaggcgcagggtctgttcctcggccgccgaggtcaattgctccaggatgacggtgctcgacgccatgatgcccttgcgctgggaccatgaccaataggtgacgaagccccacagcaccaggagcatggctcccagcagcgccaccatgatgcggcggttggaggggcggaactccaccggccgggcctacagggtttcctggaagcggaccggctcgcccgaggcctggcctagcaactggccgtcgcgcatgaccgtgcggccgcgcacgatggtggccaccggccagccggtgaccttctgcccgtcgaagggcgtccagccgcagcggctttcgatccagttgttggtgatggtgcgctcggccttcatgtcgacgacggtgaagtcggcgtcatagcccacggcgatgcggcccttgccggcaatattatagatgcgggccgggcctgcgctggtcaggtccaccaggcgttccaggctgaggcggccatgattgacgtggtcgagcatcaggggcaccagggtctggacgccggtcatgcccgacgggctttgcggatagggcttgtccttctcctcgcgggtgtggggcgcgtggtccgagcccagcacgtcgacgacgccgtcggcgatggccttccacagggcgtcgcgatggcgggtgccgcggatgggcgggttcatctgggcgtaggtgcccaggcgctcatagcattccggcgcggccagggtcaggtgctgcggcgtggtctccaccgtggccacgtccttgtgaccggccaggaactccatttcctcggcggtggtgacgtgcagcacgtggacgcggcgcccggccttttccgccagggcgacgaggcgcctgctggccatcagggcggtctccacgtcgcgccactggtgatggacgcggggatgggcgccgtcctcggccacgtgcttgcgctcgatcaggcggccctcgtcctcgcaatggacggcgatgcggcggaagccctgggccagcacccggcccagggtctcgtcgtcggccaccagcaggttgccggtggacgaccccatgaacaccttgatgccggcgcagccggggatgcgctcccactcggccagatggtcgatgttgtccgaggcggcgccgatgaagaaggcgtgatccacccaggcgcggccctgggcgcggtccagcttgtcccggatggcgtcggcggtggtggtggacggcttggtgttgggcatctcgaagatggcgaccacgccgccctgggcggcggcgcgcgtgccgctttccaggtcttccttgtgctccaggcccggctcgcggaaatgtacctgggtgtcgatgattccgggcagcacggtcaggccgcgcaggtccacctcatcggcggccgaggcgtcgagcaggctgcccaaggcccggatgcggccgtcgctgaccgcgatgtcggcgcgtccggtgccgttgggggtcaccaccatgccgttgcgcaggatcaggtcgaaggactgggccatggcgcttctccacttaagttacgcagcgattatatcctatccgccaactcggagaaggcatctccggcgggaatcttgcccaggacgtgtctttgatgccaaagggcgtagaacagcagcgtccaacaggcgaagcccgtgtccttggcgcaagtcctgaacagcgcctcgaccgcgccgggatggcagatctcggcgatgccgggctgtcgggccaccaattggccgatttggggtttcgccgcgatccactcggccaccggcacggtgaagccgcgcttcttgtcgaaggggcgggcggcgggcagtgccgtctccagccagcggcgcaggatccacttgcccagccccttccggaccttgagatggtcgggcaggcggaaggcgaaggcggcgaccaccggatcgaggaagggcacgcgcccctcgatgccgttggccatcaggcagcggtcggccttggtcagcaggtcgttgggcagccagtcggtgcagtcgaccgcctgggccacctgcagccgggtgcggccgggcagggcctcggcccgctcggccagcttcatgccgtggcgccagtggctggtgattccgtcgcgcagcacgtcgaggccgtcgaaggtgcccttgcggcgcatggacttggtcagcggccaggggcgcatggcgtggcgatagcggccatagccgccgaacagttcgtcgccgccttcgcccgacaggatgaccttgacctccttcctcgcctcgcgggccagcttgaaggtgggcaggcaggcgtagtcggcggccggatcgtccatggcggcggcgaccaagggcagcagctcccagaagtcgctttccgtgaactccacctccacgtggcgggcgcccacggcgcgggccagatcgcgggcatgctggcgctcgtcatgcaccctggtgccgggaaagccggcggtgaaggccagcacgcccttggggttgagccgggccatcagggccagcaccaccgacgaatcgatgccgcccgacaggaacatgccatagggcacgtccgagcgctggtgcagttccaccgattcggtcagcgtgtcgtccaactggtccagcatctggtccaggccgccgtccaccggcccgccggcgggcaaggcgggcaggcggcggccttccgtgacgcagcctccttcggccaccacggtctcgcccgcacccaggcggcgaatgcccttgaagatggtccgggtgccggtggtgaactgcaattgcagcaattccgccagggcggcggggtccagctcgggcttgaccagcccggcggcgatcagggcctggggctcggaggcgaaggccaggccgggagcggtctccgtcaggtaaagcggcttgatgccgaagggatcgcggccgagaaccagcttctgcgccccgccgtcgtggatggcgaaggcgtacatgccgcgaagcgagcgggcgaaggccgggccctggtggcggtacaggtgcagcggcggctcgcaatcggagccggtggcgaagacctgtcccgccatgtccgatttcagttccaggtaattgtagatctcgccattggccacgatggcgttgcccgcgccgtccaggatcggctgcctgccgccctccaggtcgatgatggacagccggttctgcaccagccccacattgccgctcacatggcggccgcgtccgtcggggccgcgatgggccagggcgtcggccagcttgtccagcacctgcccgtcgggcgggccgttggcggtcatgacgccggcgatgccgcacatcagcgtcgctccatcgatgtcatcccgagcgtcggcgagggatctccgcctgctccgctggtgccgattctgacgcatgggatcaggacgagatccttcctcccgatggtcgtcaggatgacaggcgaggtcatcgcttcaccttgtcgaagaattcgagatagcgcgccaccacggcggcctccgtgaactggcgttcataggcggcgcgaccggcctcggccagggcgcgggcggtgtcgggctgggccagcaggcggcggatggccgcggccagggcggtgccgtcatccaccggcaccagcacgccgtcggttccgtcggtgatcagctgccttggcccctgggaggctgttgcgatcaccggccgggcggccgcccaggcctcgatcaccacattgcccagcggctcgtggcgcgaagggcagacgaacaggtcgccggtggcgtacagcgccgccacgtcgtcgcgccagcccaggaatcgcacccggggcttgaccgacagatgggcggccagggcttccagctcggcgcgctcggggccttcgccggcaatccacagatagcaatcgtgcacctgttccaccgcgcggagcaggacgtcgaaggccttgttggcatgcaggcggcccatggcgacgatcaaaggtgcgccgggcggcgtgtcgaacgacgcccgcgacagcggctgggtgcccttggtgtcggcgacgaaattgggaacgtagtgaacctgaccggtcggtcgacctttggcgatgatccagtcgcggatatccggggtgttgccgatcaggtggtcgcactggcggtaatacttgaggtcgtaatagccgccgaggcgtcccaccgtggtgtggcggcccttgggcacgaagcgcgacgcccggttcatccaggtcagcacgatatcgggctggaagtccttcacctcgcggcgaaagcgccagtgggtgaccagatccagggcgccgccgaatggggcttccaccacctcgaccccctgggcgcgcagcagggcggcgcgcttggggttgtcgcggatcagcacgcgctgggtcacgccggcccgggacagggcgggggcgaggcgctcgaagaaggcctcggccccgccatggggggctccggccatggcctgaagcagccgcgtcatttcagccagccttccagggtggcggccacgccgtcccaggtacggcccttccaggcggcacgggcctcggcactcatggcttgttgcactgactggtcggtcagcagcaggacggccagattggcgaaggcgtcgtcatcgggggcgacgtagccggtgacgccatcccggatgcgctcgggggcggcgcccaggggggcggattaccgccggacagcctgccgcctggctttccatcagggtgaagcagcccatgtcgtcggcatggccgggatagagatggacgcgggcctcgcgcagggcctcggccatcaggtagtcgccctgggggcgggtgaccaccacgccgtgggcggcggcggcggcgaccttggcggccagggggcgcagggcctcgtccacctccttgccctcggcggcggaggccagggtcatggaatggatgtgcagttcggcactgggcgcattggggcggatcctggccacccacagatccaccagccagtccaggccgtgggcgggatgggtggtgaccacggcgcgcggcgggtcctgggggcggggctcgccgcccaggaaatcggggcgtaccgccatgggcagcagcccggcggccagccccttggtctggaagtcccgcgcctgggcctcggccagcagcagcagcagcggcttgtgggtgtcgagcatggcccgcgtcgccgggcggtccagcaggcgtcccggccccacatgccagaacacccgcttgcccgcatggcggatgaattccagaagctggggcttgcggaaggcgatcagcacgtcggtgcgcagcggcttcttgccctcgaaggtctcccactgggcgctttcgatatgcatgccccagcggcagcggttgaacacctgcaccgtatggccgagacgggccagggcgccgggcagcacggcaaaggccttctccgccccgcccagcgggcgcgatgacgcggaatagccgtcgaagggaatggaatcgtccacgagggtgatatgcatggtttgaatcttataagacgcccgggggggcttgtcatcccagctggtttgacccaccctttgcctggaagggttgcctgagaggatttggccgatgagcgacagggtctttgtgcgtctggaacagcgtgccgtgctggaagtggggggcgaggaccgccgcgccttcctgcagggtctggtctccaacgacatgaacaaggtggccggcgaccgggcggtgtacaccgccctgctgaccccccagggcaaattcctgtacgacttgttcgtggtggaactgggcgacgtcttcctgatcgacgcggaagccgcgcgcatcgaggaactgaggaaaaagctctccatgtacaagctgcgctccaaggtgagcgtcgccgtggccgccaatgtggcggtgttcgccctgatgggcgagggggcggcctccaccttcgaccttgccgccgaggccggtgccgccaccgaattccgggaccagggccgggatgcggttccgcagacggggacgggtcccgtcgcaggcgccaccatcaccagtcaggtccaggaagtggtccaggccgaggtcgccgcggcgcccgccgtggacaatgcccctgacatccaggccgtggcggtcaatcacgcgccgatcgtcgcgggcgtggccgacatcgggacgatcgacgaggatcatcccctgaccatgaccgccgcggaatggcaggccaagctgttggccaatgccacggattccgacggcgacaccttgtcgattctcagcctggacgatatccggatcgaccatggcagctttgcccggaatgccgacggcacctataccttcacgccggatgccaatttcaacggcgagatcaacgcgacttataccatttccgatggtcacggtgggcttgcgaccgggtcggcgtcgctgcatgtcaatgcggtgaacgacgcggccgagatcaccggcgacaccgccgtggtggtgggtgaggatacggcgcgggcggccggcaatctggacgccaccgacatcgattctccggccaccttcgtggcggcgacgacggcggatgattacggcaccttctcggtggacgagagcggccagtggtccttcgccatgaacgattccgtgcagtcgcttggggcgggtgaccacctgacccggaccttcgaggtccagacggcggacggcacctctcagacggtgacggtgaccatcgacggtgccaatgaccaggcggtgatctctggcgacgccaaggacctgtcgggttccgtcggcgaggacggcacccagaccgccaccgggactctccatgtctccgacgtggacagcggcgaggcccatgtccaggccaccagcgtcgagaccgaccagggcaccttcaccatcggcgaggacggcaagtggtcgttcgcgctcaacaacgacgacccggcggtgcaggccctgggcgccaatgattccatgaccaagaccttcacggtcaccagcgccgatggcaccgacacccaggaagtgacggtcaccatccacggcagcaacgacagcgccaccatcagcggcgacatcgccggcggcgtcggcgaggacggcaccggcacggcgaccggcaccctcaacgtctccgacgtggacagcggcgaggcccatgtccaggccaccagcgtcgagaccgatcagggcaccttcaccatcggcgaggacggcaagtggtcgttcgccctcaacaacgacgacccggcggtccaggccctgggcgccaatgattccatgaccaagaccttcacggtgacgagtgccgacggcaccgacacccaggaggtgacggtcaccatccacggcagcaatgacagcgccaccatcagcggcgacatcgccggcggcgtcggcgaggacggcacttctacggccaccggcacgctcaacgtggcggatgtggataatggcgaggcccatgtccaggccaccagcgtcgagaccgatcagggcaccttcaccatcggcgaggacggcaagtggtcgttcgccctcaacaacgacgacccggcggtccaggccctgggcgccaatgagtccatgaccaagaccttcacggtcaccagtgccgatggcaccgacacccaggaagtgacggtcaccatccacggcagcaatgactcggccaccatcagcggcgacatcgccggcggcgtcggcgaggacggcacttctacggccaccggcacgctcaacgtggcggatgtggataatggcgaggcccatgtccaggccaccagcgtcgagaccgaccagggcaccttcaccatcggcgaggacggcaagtggtcgttcgccctcaacaacgacgacccggcggtccaggccctgggcgccaatgattccatgaccaagaccttcacggtgacgagtgccgacggcaccgacacccaggaggtgacggtcaccatccacggcagcaatgacagcgccaccatcagcggcgacatcgccggcggcgtcggcgaggacggcacttctacggcgaccggcaccctcaacgtctccgacgtggacagcggcgaggcccatgtccaggcgaccagcgtcgagaccgatcagggcaccttcaccatcggcgaggacggcaagtggtcgttcgccctcaacaacgacgacccggcggtccaggccctgggcgccaatgagtccatgaccaagaccttcacggtcaccagcgccgacggcaccgacacccaggaagtgacggtcaccatcaacggnnccaatgacacggccaccatctccggcgacatcgccggcggcgtcggcgaggacggcaccggcacggcgaccggcaccctcaacgtctccgacgtggacaacggcgaggcccatgtccaggccaccagcgtcgagaccgatcagggcaccttcaccatcggtgaagacggcaagtggtccttcgcgctgaacaacgacgacccggcggtccaggccctgggcgccaatgattccatgaccaagaccttcacggtgacgagtgccgacggcaccgacacccaggaggtgacggtcaccatccacggcagcaatgacagcgccaccatcagcggcgacatcgccggcggcgtcggcgaggacggcaccagcacggccaccggcaccctcaacgtctccgacgttgactccggcgaggcccatgtccaggccaccagcgtcgagaccgatcagggcaccttcaccatcggcgaggacggcaagtggtcgttcgccctcaacaacgacgacccggcggtccaggcactgggcgccaatgagtccatgaccaagaccttcacggtgacgagtgccgacggcaccgacacccaggaggtgacggtcaccatccacggcagcaatgacagcgccaccatcagcggcgacatcgccggcggcgtcggcgaggacggcacttctacggccaccggcacgctcaacgtggcggatgtggataatggcgaggcccatgtccaggccaccagcgtcgagaccgatcagggcaccttcaccatcggcgaggacggcaagtggtcgttcgccctcaacaacgacgacccggcggtccaggccctgggcgccggcgattccatgaccaagaccttcacggtgacgagtgccgacggcaccgacacccaggaagtgacggtcaccatcaacggcagcaacgacaacgccaccatcagcggcgacatcgccggcggcgtcggcgaggacggcacttctacggccaccggcaccctcaacgtgtccgacgtggataatggcgaggcccatgtccaggccaccagcatcgagaccgaccagggcaccttcaccatcggtgaagacggcaagtggtccttcgcgctgaacaacgacgacccggcggtccaggccctgggcgccaatgagtccatgaccaagaccttcacggtgacctctgccgacggcaccgacacccaggaggtgacggtcaccatccacggcagcaacgacagcgccaccatcagcggcgacatcgccggcggcgtcggcgaggacggcaccggcacggcgaccggcaccctcaacgtggcggatgtggacaatggcgaggcccatgtccaggcgaccagcgtcgagaccgatcagggcaccttcaccatcggcgaggacggcaagtggtcgttcgccctcaacaacgacgacccggcggtccaggccctgggcgccggcgactccatgaccaagaccttcacggtcaccagcgccgatggcaccgacacccaggaggtgacggtcaccatccacggcagcaacgacagcgccaccatcagcggcgacatcgccggcggcgtcggcgaggacggcaccagcacggcgaccgggactctccatgtctccgacgtggatacgggcgaggcccatgtccaggccaccagcgtcgagaccgaccagggcaccttcaccatcggtgaagacggcaagtggtcgttcgccctcaacaacgacgacccggcggtccaggccctgggcgccaatgattccatgaccaagaccttcacggtcaccagcgccgatggcaccgacacccaggaggtgacggtcaccatccacggcagcaacgacagcgccaccatcagcggcgacatcgccggcggcgtcggcgaggacggcaccggcacggcgaccggcaccctcaacgtggcggatgtggacaatggcgaggcccatgtccaggcgaccagcgtcgagaccgatcagggcaccttcaccatcggcgaggacggcaagtggtcgttcgcgctcaacaacgacgacccggcggtccaggccctgggcgccaatgattccatgaccaagaccttcacggtgacgagtgccgacggcaccgacacccaggaagtgacggtcaccatccacggcagcaatgacagcgccaccatcagcggcgacatcgccggcggcgtcggcgaggacggcaccggcacggcgaccggcaccctcaacgtctccgacgtggacagcggcgaggcccatgtccaggcgaccagcgtcgagaccgatcagggcaccttcaccatcggcgaagacggcaagtggtcgttcgccctcaacaacgacgacccggcggtgcaggccctgggcgccaatgagtccatgaccaagaccttcacggtgacctctgccgacggcaccgacacccaggaagtgacggtcaccatccacggcagcaacgacagcgccaccatcagcggcgacatcgccggcggcgtcggcgaggacggcaccagcacggcgaccgggactctccatgtctccgacgtggatacgggcgaggcccatgtccaggccaccagcgtcgagaccgaccagggcaccttcaccatcggtgaagacggcaagtggtcgttcgccctcaacaacgacgacccggcggtccaggccctgggcgccaatgattccatgaccaagaccttcacggtcaccagcgccgatggcaccgacacccaggaggtgacggtcaccatccacggcagcaacgacagcgccaccatcagcggcgacatcgccggcggcgtcggcgaggacggcaccggcacggcgaccggcaccctcaacgtggcggatgtggacaatggcgaggcccatgtccaggcgaccagcgtcgagaccgatcagggcaccttcaccatcggcgaggacggcaagtggtcgttcgccctcaacaacgacgacccggcggtgcaggccctgggcgccggtgattccatgaccaagaccttcacggtcaccagcgccgatggcaccgacacccaggaagtgacggtcaccatcaacgggtccaatgactcggccaccatctccggcgacatcgccggcggcgtcggcgaggacggcacccaggccgcgaccggcacgctcaacgtggcggatgtggacagcggcgaggcccatgtccaggcgaccagcgtcgagaccgatcagggcaccttcaccatcggtgaagacggcaagtggtcgttcgccctcaacaacgacgacccggcggtgcaggccctgggcgccaatgattccatgaccaagaccttcacggtcaccagcgccgacggcaccgacacccaggaggtgacggtcaccatccacggcagcaacgacagcgccaccatcagcggcgacatcgccggcggcgtcggcgaggacggcaccagcacggcgaccgggactctccatgtctccgacgtggatacgggcgaggcccatgtccaggccaccagcgtcgagaccgaccagggcaccttcaccatcggcgaggacggcaagtggtcgttcgccctcaacaacgacgacccggcggtgcaggccctgggcgccaatgagtccatgaccaagaccttcacggtgacgagtgccgacggcaccgacacccaggaggtgacggtcaccatccacggcagcaacgacagcgccaccatcagcggcgacatcgccggcggcgtcggcgaggacggcacttctacggccaccggcaccctcaacgtgtccgacgtggataatggcgaggcccatgtccaggccaccagcatcgagaccgaccagggcaccttcaccatcggtgaagacggcaagtggtccttcgcgctgaacaacgacgacccggcggtgcaggccctgggcgccggtgattccatgaccaagaccttcacggtcaccagcgccgatggcaccgacacccaggaagtgacggtcaccatccacggcagcaacgacagcgccaccatcagcggcgacatcgccggcggcgtcggcgaggacggcaccggcacggcgaccggcaccctcaacgtctccgacgtggacagcggcgaggcccatgtccaggccaccagcgtcgagaccgatcagggcaccttcaccatcggcgaggacggcaagtggtcgttcgccctcaacaacgacgacccggcggtccaggccctgggcgccaatgagtccatgaccaagaccttcacggtgacgagtgccgacggcaccgacacccaggaggtgacggtcaccatccacggcagcaatgacagcgccaccatcagcggcgacatcgccggcggcgtcggcgaggacggcacttctacggccaccggcacgctcaacgtggcsgatgtggataatggcgaggcccatgtccaggccaccagcgtcgagaccgatcagggcaccttcaccatcggcgaggacggcaagtggtcgttcgccctcaacaacgacgacccggcggtccaggccctgggcgccggcgattccatgaccaagaccttcacggtgacgagtgccgacggcaccgacacccaggaagtgacggtcaccatcaacggcagcaacgacaacgccaccatcagcggcgacatcgccggcggcgtcggcgaggacggcacttctacggccaccggcaccctcaacgtgtccgacgtggataatggcgaggcccatgtccaggccaccagcatcgagaccgaccagggcaccttcaccatcggtgaagacggcaagtggtccttcgcgctgaacaacgacgacccggcggtccaggccctgggcgccaatgagtccatgaccaagaccttcacggtgacctctgccgacggcaccgacacccaggaggtgacggtcaccatccacggcagcaacgacagcgccaccatcagcggcgacatcgccggcggcgtcggcgaggacggcaccggcacggcgaccggcaccctcaacgtggcggatgtggacaatggcgaggcccatgtccaggcgaccagcgtcgagaccgatcagggcaccttcaccatcggcgaggacggcaagtggtcgttcgccctcaacaacgacgacccggcggtgcaggccctgggcgccggtgattccatgaccaagaccttcacggtcaccagcgccgatggcaccgacacccaggaggtgacggtcaccatccacggcagcaatgacagcgccaccatcagcggcgacatcgccggcggcgtcggcgaggacggcaccagcacggccaccggcaccctcaacgtctccgacgttgacwccggcgaggcccatgtccaggccaccagcgtcgagaccgaccagggcaccttcaccatcggcgaggacggcaagtggtcgttcgccctcaacaacgacgacccggcggtccaggccctgggcgccggcgactccatgaccaagaccttcacggtcaccagcgccgatggcaccgacacccaggaggtgacggtcaccatccacggcagcaacgacagcgccaccatcagcggcgacatcgccggcggcgtcggcgaggacggcaccggcacggcgaccggcaccctcaacgtctccgacgtggacagcggcgaggcccatgtccaggccaccagcgtcgagaccgatcagggcaccttcaccatcggcgaggacggcaagtggtcgttcgccctcaacaacgacgacccggcggtccaggccctgggcgccaatgagtccatgaccaagaccttcacggtgacctctgccgacggcaccgacacccaggaggtgacggtcaccatcmacggcagcaacgacagcgccaccatcagcggcgacatcgccggcggcgtcggcgaggacggcacttctacggccaccggcaccctcaacgtgtccgacgtggataatggcgaggcccatgtccaggccaccagcatcgagaccgaccagggcaccttcaccatcggtgaagacggcaagtggtccttcgcgctgaacaacgacgacccggcggtccaggccctgggcgccaatgagtccatgaccaagaccttcacggtgacctctgccgacggcaccgacacccaggaggtgacggtcaccatccacggcagcaacgacagcgccaccatcagcggcgacatcgccggcggcgtcggcgaggacggcaccggcacggcgaccggcaccctcaacgtggcggatgtggacaatggcgaggcccatgtccaggcgaccagcgtcgagaccgatcagggcaccttcaccatcggcgaggacggcaagtggtcgttcgccctcaacaacgacgacccggcggtgcaggccctgggcgccggtgattccatgaccaagaccttcacggtcaccagcgccgatggcaccgacacccaggaagtgacggtcaccatccacggcagcaacgacagcgccaccatcagcggcgacatcgccggcggcgtcggcgaggacggcaccggcacggcgaccggcaccctcaacgtctccgacgtggacagcggcgaggcccatgtccaggcgaccagcgtcgagaccgatcagggcaccttcaccatcggcgaggacggcaagtggtcgttcgccctcaacaacgacgacccggcggtccaggccctgggcgccaatgattccatgaccaagaccttcacggtgaccagtgccgacggcaccgacacccaggaggtgacggtcaccatccacggcagcaatgacagcgccaccatcagcggcgacatcgccggcggcgtcggcgaggacggcaccagcacggccaccggcaccctcaacgtctccgacgtggactccggcgaggcccatgtccaggccaccagcgtcgagaccgaccagggcaccttcaccatcggcgaggacggcaagtggtcgttcgccctcaacaacgacgacccggcggtccaggccctgggcgccggcgactccatgaccaagaccttcacggtcaccagcgccgatggcaccgacacccaggaggtgacggtcaccatccacggcagcaacgacagcgccaccatcagcggcgacatcgccggcggcgtcggcgaggacggcaccggcacggcgaccggcaccctcaacgtctccgacgtggacagcggcgaggcccatgtccaggccaccagcgtcgagaccgatcagggcaccttcaccatcggcgaggacggcaagtggtcgttcgccctcaacaacgacgacccggcggtccaggccctgggcgccaatgattccatgaccaagaccttcacggtgacgagtgccgacggcaccgatacccaggaggtgacggtcaccatccacggcagcaatgacagcgccaccatcagcggcgacatcgccggcggcgtcggcgaggatggcacctctacggccagcggcaccctcaatgtgtccgacgtggataatggcgaggcccatgtccaggccaccagcgtcgagaccgaccagggcaccttcaccatcggcgaggacggcaagtggtcgttcgccctcaacaacgacgacccggcggtccaggccctgggcgccggcgattccatgaccaagaccttcacggtgacctctgccgacggcaccgacacccaggaagtgacggtcaccatccacggcagcaacgacagcgccaccatcagcggcgacatcgccggcggcgtcggcgaggacggcaccggcacggcgaccggcaccctcaacgtctccgacgtggacaatggcgaggcccatgtccaggccaccagcgtcgagaccgatcagggcaccttcaccatcggtgaagacggcaagtggtccttcgcgctcaacaatgacgacccggcggtccaggccctgggcgccaatgagtccatgaccaagaccttcacggtgacctctgccgacggcaccgacacccaggaggtgacggtcaccatcaacggcagcaacgacagcgccaccatcagcggcgacatcgccggcggcgtcggcgaggacggcacttctacggccaccggcaccctcaacgtgtccgacgtggataatggcgaggcccatgtccaggccaccagcatcgagaccgaccagggcaccttcaccatcggtgaagacggcaagtggtccttcgcgctgaacaacgacgacccggcggtccaggccctgggcgccaatgagtccatgaccaagaccttcacggtgacctctgccgacggcaccgacacccaggaggtgacggtcaccatccacggcagcaacgacagcgccaccatcagcggcgacatcgccggcggcgtcggcgaggacggcaccggcacggcgaccggcaccctcaacgtgkcggatgtggacaatggcgaggcccatgtccaggcgaccagcgtcgagaccgatcagggcaccttcaccatcggcgaggacggcaagtggtcgttcgccctcaacaacgacgacccggcggtgcaggccctgggcgccggtgattccatgaccaagaccttcacggtcaccagcgccgatggcaccgacacccaggaagtgacggtcaccatccacggcagcaacgacagcgccaccatcagcggcgacatcgccggcggcgtcggcgaggacggcaccggcacggcgaccggcaccctcaacgtctccgacgtggacagcggcgaggcccatgtccaggccaccagcgtcgagaccgatcagggcaccttcaccatcggcgaggacggcaagtggtcgttcgccctcaacaacgacgacccggcggtccaggccctgggcgccaatgagtccatgaccaagaccttcacggtgacgagtgccgacggcaccgacacccaggaggtgacggtcaccatccacggcagcaaygacagcgccaccatcagcggcgacatcgccggcggcgtcggcgaggacggcaccagcacggccaccggcaccctcaacgtctccgacgtggactccggcgaggcccatgtccaggccaccagcgtcgagaccgaccagggcaccttcaccatcggcgaggacggcaagtggtcgttcgccctcaacaacgacgacccggcggtccaggccctgggcgccggcgactccatgaccaagaccttcacggtcaccagcgccgatggcaccgacacccaggaggtgacggtcaccatccacggcagcaacgacagcgccaccatcagcggcgacatcgccggcggcgtcggcgaggacggcaccggcacggcgaccggcaccctcaacgtctccgacgtggacagcggcgaggcccatgtccaggccaccagcgtcgagaccgaccagggcaccttcaccatcggcgaggacggcaagtggtcgttcgcgctgaacaacgacgacccggcggtgcaggccctgggcgccaatgattccatgaccaagaccttcacggtgacgagtgccgacggcaccgatacccaggaggtgacggtcaccatccacggcagcaatgacagcgccaccatcagcggcgacatcgccggcggcgtcggcgaggatggcacctctacggccagcggcaccctcaatgtgtccgacgtggataatggcgaggcccatgtccaggccaccagcgtcgagaccgaccagggcaccttcaccatcggcgaggacggcaagtggtcgttcgccctcaacaacgacgacccggcggtccaggccctgggcgccggcgattccatgaccaagaccttcacggtgacctctgccgacggcaccgacacccaggaagtgacggtcaccatccacggcagcaacgacagcgccaccatcagcggcgacatcgccggcggcgtcggcgaggacggcaccggcacggcgaccggcaccctcaacgtctccgacgtggacaatggcgaggcccatgtccaggccaccagcgtcgagaccgatcagggcaccttcaccatcggtgaagacggcaagtggtccttcgcgctcaacaatgacgacccggcggtccaggccctgggcgccaatgagtccatgaccaagaccttcacggtgacctctgccgacggcaccgacacccaggaggtgacggtcaccatccacggcagcaacgacagcgccaccatcagcggcgacatcgccggcggcgtcggcgaggacggcaccggcacggcgaccggcaccctcaacgtctccgacgtggacagcggcgaggcccatgtccaggccaccagcgtcgagaccgatcagggcaccttcaccatcggcgaggacggcaagtggtcgttcgccctcaacaacgacgacccggcggtccaggccctgggcgccggcgattccatgaccaagaccttcacggtcaccagcgccgacggcaccgacacccaggaagtgacggtcaccatcaacgggtccaatgacggcccggtggtgagcggccccgtggatctcggcgcgaccgccgaggatcactccatcaccttcacggcgcagcaattgctgggccatgcctcggacatcgatggcgacagcctgtcggtgagcaatctcagtgccggtaacggcaccatcagccagaatgccgacggcagctataccttcacgcccaatgccgacttcaacggcgaggtcaacgtgacctacaccgtgtcggacgggcatggcggcaccacttcgggttcggccagcttcgacgtgacctcggtcaatgacggcccgaccaccagcgatgtgacgctggcctcggggaccgaggaccgctcggtgaccatcaaggccagcgacctgctgggcaacgcccatgacgtggacggcgataccttgtcggtgtcgaacctgtcggccagcaacggcaccatcaccgacaaccatgacggcacctataccttcacgccgaaccatgatttcagcggcaacgtcgacctgtcctacacggtcagcgacggccagggcggcagcacggcgggcacggcccatttcggcatggccgcggtggcggattcgccggtcctgtcggcgtcgaacattaccgtcgacctgggagccggccaggctcagaccctgaacggcaccaccggcaacgacaccctgagcggcggttcgggcaatgacgtggtcaacggctcgtcgggcgacgacgtgctgtatggcgacggcaccggcagcgtgacggttccgctgaacatcagcgaccgcctgagcgacaccgacggttcggaatccctgggcagcgtgaccatcggcggtctgccggccggggcgagcctgtctgcgggcacccataattccgacggcacctggactctgactccggcgcagctgacgggcctcagcgtgaccaccaccgagggcaccgccctgcatctgagcgtgacggcgacctcgaccgaggcgtccaacggctcgaccgcgaccaccaccaccagcttcgacgtcagcttcagcggcacggccgccggcaatgacaccctggacggcggggcgggcaacgacaccctgttcggcggggccggcaacgacaccctgacgggcggcgcgggcgccgacctgctggagggcggcgacggcaacgacgtgctgaactactcgaccgacgggacctggagcggcggtttcgtgtcgcagaacgtgggtgataccacccatgcgggcaccaacgagacctataccatcaccggtgacaacgacagccaggacgtgttccgcggcggcgccggcaccgacaccctggtgatgggctcgggcaatgacgctctgttcctggacgacggctatagcggctcgcccaccggcggcgcgcgcatcgacggcatcgagagcattgtggccggcgacggcaacgacgtggtcgacctgacgtcgagcaagtacacctatggcgacgtcaccatcgacggcggcgccggcaacgacgtactgatgggcaatgccggcaacgacgtcatcgacggcggcaccggcaacgacgtgctgtatggcgcttcgggcaacgatacgctgcggggcggcgatggcgccgataccctggacggcggctatggcgccgacaccatcgacgcgggcgccggcaacgaccttggcatcatcaagggcggccagtcggcgggcgacaattacgacggcggcaccggcaccgacacgctgcgcatcgacctttccgggtcgcaatacaccgcggcggtgcgcgccgagctgcagcagttccagtccttcatcgccgatccggcccatgccggccaaagcttccacttcaacaccctgggtgttgacgccaagaactgggaaagcctgaagctgacggtggacggccgcgacgtctcgctggagaacgctccgacggtgaccagcgccacggcggtgagcaccgacgaggatcattcgggcgccggccgcgtggtcgggaccgaccaggacgtgggcgacagcgtgcgctaccacctgatggatgccagcggcaaccaggtggacagcctgtcgaccgcccatggcacggtgaccatcaactcggccaccggcgagtacaccttcacccccaatgccgacgcgcagagcctgcgggctggcgacgtgcagaccgacagcttcaaggtcgtggccaccgacggcaccatgaccagcgcgccctcgaccgtgggcgtcaccatcaccggcagcaatgacggcgcggtgatcaccggcaccagcgtgggcacggtgggcgaggacggtaaccgctcggtgaccggcacgctcaacgtcgccgatgtggatcaggggcaggcccatgtgaccgcccagacggtgcagaccgatcagggcactttcagcatcggcgagaacggccagtggaccttccaggtcaactcgggcaatgccgacgtgcaggccctgggggccggcgagtccatgaccaagaccttcgccgtggcctcggccgatggcaccgccacccagaacgtgacggtgaccatcaacggcgccaatgactccgccaccatctcgggctcgaccaccggcgcggtggccgaggacggcaacggccgcgccaccggcacgctgagcgtcgccgacgtggatcacggtcaggcccatgtgaccgcccagacggtgcagaccgatcagggcaccttctccatcggcgagaacggccagtggaccttccaggtcaactcggccaatgccgacgtgcaggccctgggcgccggcgagtccatgaccaagaccttcgccgtggcctcggccgacggcaccgcacccagaacgtgacggtgaccatcaacggcgccaatgactccgccaccatctcgggctcgaccaccggcgcggtggccgaggacggcaacggccgtgccaccggcaccctcaacgtggccgacgtggatcacggtcaggcccatgtgaccgcccagacggtgcagaccgaccagggcactttcagcatcggcgagaacggccagtggaccttccaggtcaactcgggcaatgccgacgtgcaggccctgggtgccggcgagtccatgaccaagaccttcgccgtggcctcggccgacggcaccgccacccagaacgtgacggtgaccatcaacggcggcaatgactccgccaccatctcgggctcgaccaccggttcggtggccgaggacggcaacggccgcgccaccggcacgctgagcgtcgccgacgtggatcacggtcaggcccatgtgaccgcccagacggtgcagaccgatcagggcaccttctccatcggcgagaacggccagtggaccttccaggtcaactcggccaatgccgacgtgcaggccctgggggccggcgagtccatgaccaagaccttcgccgtggcctcggccgacggcaccgccacccagaacgtcagcgtcaccatcaccggctccaatgacggcccgacggtgagcggcgcggtgggtctcggccacacggccgaggacaattccgtcaccttcaccaaggcgcagctgctggccaacgcccatgacaccgatgcccacgacaccctgtcggtgagcaacctgtcggcggcccacggcagcatcgtcgacaacggcaacggcacctacaccttcacgcccaccgagactttcagcggccatgtggatgtgagctataccgtcagcgacggccatggcggcaccaccaccggttcggcggcgctggacgtggacgcggtggccgaccgggccacggtgtcggtggccatcggcgccccggtggagacccccaacggcagcttcaccgtcaccaatttggacagcacggcctcggccggctacaacaacacctatggctattacgtcatggacgacagcggcaacccgacttcgggtggcgtgatctggtccaacgtgcatgcctcgcccggcgcttcggtgaccatcagcggcgtcgatcccgaccgggtcggcttcttcctgatccccgacggcggcagccagaattcgttgaggccgcgcaacgccgtggtggtcagggccgccatctgggtggtgcccagggcggccaattgggtttcgtcaaactcggacagggcccggacgccgaggcccttcacctgatactgattgagccccgcgatctgtgtcgcgctcaggccatgcacttgttcggcgctcagcatgccgatctgcgtcgccgacaaggcgttgagctgggtcgcggtcagcccctgcaggtggccctgggtcaggcccatgatggcggtcagcgaaagggcggcgatctgggcgccgctcagcgcctgcagctgatccaccgtcagggtgccgacctcggtggccgacagcgccttgacctgggtgacgctgaacgcccccacctgggacggagtcagcgccgccacctggtcctcggtcagccagccgacctcggtggccgacaggccgcgcacctgggtggcggtcaggccggcgatctcggcggtggaaaaggtgctgaactgggtggtggtcagcacgccgatctgcgccgccgacagccccccgatctgggtggcgtccagggattccacggcttcggaggacaggccgagaatctgggaggtgttgaaggccgccacctgggtggcggtcagcaggtcgatctgctcggcatcaagccccgccacgccccgtgtgcttagatacgaaatctgcgtggtggacatcgtcgacagttgggtatcggtgagtccggccacttgcttggcggtcagggaccccaattgggtggaactcagcgccgccatctgggtggcgttcaaggtggcgatggcggtggtcgacagaaactggaactgcgacgaggtgatggccgccagttgggtctggctcagcacccccacctgggtcacatcgaatccctggacgccgaacatgctgagcgccgccacctgactggtgcccagtgccgccatctgggcggcgctcatgccgcccgtggccgtctgggtcaggccgcgcatctgggtggtggacagggccgccacctgggagggactgaacgcggtgatctgggtggacgacagggccagcatggcggtgatggacaagccgcttaactgggccagggtcagcgaggccagggtctcggtcgccagcccgctcacctgggaaccgttcatcacggaaagctggaccgctcccatcccggtcatctgggtagggctcagcgccccggtctcggtggcggtcagccccttgatctgggtgacggacagtacggacaactgggacggggccagggcctggaactgggtgaccgtcatctcgcccaggtcggtggcggtcagtcccttgatctgcagcgtggacagcgactggatgacgtcgacgccgaacgcatcgaactgggcgtcgagcagaaccgacagctggtcgccgctgaacgccgcctgggagggggtcagagcgccgatctgagtctcggtcagccccgtcatctgggtggtgctgaacgacgacagctgggtgccgctcatctcctggatctgggagacgctgaaggcggcgatctggaaggtgctgagttcgcggatatcggaggcggtcaggtcccgaatggccgagccgctcagttgagcgatctgcgcctcattcatcaacgatatggacgagaccatgggtgcttctccgaccggaccctaggagatcacggcgatgccagacctgatttcgcgtggcgacgcaagaaacatgccgaaccccgtcttccggcgggacaaggaaaaacctgtgtttcttatagggatgatcgagggcttcgtcccggcaaattttgcctagggcacatattgccgaggtattcctgcccactcgggttcaggccaaatccgaacggttcattcggatttggcctggataactcatttcgtccctcgccgggcgcaaacccgtgggttgcgcatcactcgccggccgaggcggggtccgggggcatgtggcggcgaatcagcggcatctggaacagcatgaaaatgaaggtcagcaccatgctgcccggcaccttccacagcacccacagatccatgctggccacgcggcggaccacctcgttggccagggccatggcgaggaagaacaggcaaaagcgcagcgacagccggcgccagccgtcatcgtccaggtgcatggcctcgcccaggatcgccttgatggtggggcgcttcagcgccagaccgccccccagaaccagggcgaacaggccatagacgatggacggcttcatcatgatgaaggtctcgtcgttcagccacagggtcagcccgccgaacacgccgaccaccagggcggtgaccagcggcatcagggcgaccttgcgggtgaaggcgaaggacagcgccagggcgattcccgtcgccgccatcagggcggcggtggcgggcagcaggcccttcagccagtaaagccccaggaacacggccagggggccgaaatctacggtgggcttcagccatttgggggcaggggaatttgaaaccggcattgctgaaccttgattgatgcttggtggtcgtcggtgcgagatgatggccgttcccggcccgtctgtcaggaggaaagatggtgtccgatgccgatggattgcagcccatttgtggcgaaattcaggaaagcgcgggtgcgggccgccatgtgacgcccccccggcacaaccagatgaaccggttgcagggcgccgcttcccggcagaacccggaccagatgcccagccgccaggtcgtcgaccacctgataggacagggcacgggcgattcccaggccggcgcgggcggcggccagggatgcctccacctgattgaccatcaggcgcggcgtcagccggacattccgctcgcggccgccctcgatcagccgccactccaccaggaccgggcgccccgaggtgaagatcacgtcatgctccgccagttcatcgacggcgaggggaaggccgtgggcggcaatgtaaccgggactggcgaccagcacgctctccacctctccgacccgccgggccaccagggtggaatcagccagcgttccgatccggaccgcgacgtccagttcctcctcgatcaggtcgaggttgttgtccgagaacaccgcctcgatggaaatttgcggataggctcgcaggaagtcgacgatgatcggcgtcacgtggcgacggccgaacaccaccggcgcggtgacgcgcagccgcccgcgcaggggctcgtcggcaccggcggagcgcaaggcctcgttatagccggacagcaggtgccgggcctgctcggcgaagcgccgtccggcgtcggtcggggccagtcggcgggtcgttcgctccaccagacgcacgcccagcctgtcctccagcccggccagacagcgggtgatggccggcggcgaccgccgcagccgccgggccgccccggccagggagcccacctccaggatggcgatgaagatggccaactcgtccaggcggtccatgtatacttccatattttgaaataatgactttcaaggatggcgctttttctccgtgtccggcaatggctaaggtgtcagaccccattcgcggagctgatcatgactgacacgtccctcattctctacggcacacccctgtccggccacgcccatagggctgagctgatgctgcgccttctcggccttgcctaccggtatgaggacggctcggcgccagtgcgccggactccggcctttctggctctcaatcccctgggccagatcccgattctggttgacggagatctggttcttcccgattccaacgccatcctggtctacctggcccggcgttacgatccgtccggggcgtggtatcccgatgacatggtgattgccgcccgcatccagcgctggctgtccatggcggcgggggaggtgcgctacggcccggccaaggcgcgggtgatccagctcttcaaggccgagggtgatctggcggccgcccaggccattgccacccagcttctggtgttcatggacgggtatctggccgatcgcgccttcctggcccatcatgctccgaccatcgccgatgtggcgtgctattcctatatcgcccatgccccggagggtggcattccgcttgatgcttatgcccatgtccggggctggctgggccgggtcgagtccttgccgggctttgtccccatgccccgttccccggtcccggactgagatgatggaactgtcgcccttccacgcgggtgagcgggaggcgcagcgccgggccggcttcggccaggtaagcgctcccatcagggacttcatgcccgatcagcaccgcgcctttttctccctgctgccgtttctgccgttggcaagcgtggacgaggacggcttcccggtggcgaccgttctgactgggccgccgggcttcatctccagccccgatcccacgacattggccatcctgtcgccgccgccttccgacgggacttgcgccctggtcgaaggagtgcccgtcggaatcctcggaatcgatcttgccacccggcggcgcaaccgcgccaacggccggatcgtctcggtcaacccctccggctttgccgtggcggtggagcagagcttcgcaactgcccgaaatacatccagacccgtgaccttgtcccggccgcggcggcgacgtccggcgtcgtcgaacgcctgagcgggctcgacgacgcggctcgcgatcagatcggggcggcggacaccgtcttcgtcgcctccttttccggagacgtcgcgcagggcggggtggacatgtcccatcgcggcggccgcccgggcttcgtgcgggtcgagggcaaccgtctgaccatccctgatttcagcggcaaccgctatttcaacaccttgggcaatttcgtgcgcttgcccagggcggcgctgctgttcatcgactttgccggcggggatctgctgcatctcgatggaaccgtgacgatcgactggcagccgccgccaggctacgctggcgcccagcgtctctggtccgttgacgtgcggagcggctggcgctgccgcggcgccttcgggctgcgcggaacggtcggggagatgtctcccgccaccctgggcaccgggtgctggccttgaagtgggctccggcctgatacgattagctgtgtctctcggatcgccctcggagggctgcgtgccgaggagagcatgcgtttgccggggcttgcgtcattttttgttcatttccacactgaaaactgtttacctttttggtgtatatgccagattggaaggtggtaaagtgccgctgatggtggcatttgccagggccgtgggatggcttggcctggtcgaagcggggggggatcccgcagcttcgttcgggccggttatgggtggttgcccacagcctgatggtgcggggcgtgtaatctgtttttcgtgaagaccatggaaatcctcattgaggatcgctttcgcatgggaattttttgggtttgaccttgccgccttgtcggtggcgcgcagcgcgtaaatggccgtctgaaactggatctggcctcattcgggagttctgctatggctgagaacaacaactccaatcctccgcatgaccagcatgacggggcggaggagaacgcacagcagtcgctagacgacctgacggtgctgcagaacgtccagaaccagaacatgggcgatgcgcgactgaatgtggcgcgcgcggttgatgtcagcgacacccagctgggcaatctggcgaatgtgcagcagggctcgacgggcagccctcaggtgcagaacctgggcggcatcgcgggcggtgcgaacatctcggtcgacgttgagatcgaagcggccaaggacaattccgtggcgccgccggaactggacggcttggccgtcgatatccgggacgaggctccgaccatttcggtcaatccgggtggggcgaagcccctgaacgtgcaggagctccctgatcttgccaggcctgacgccgaattccgggaccagggccgggatgcggttccgcagacggggacgggtcccgtcgcaggcgccaccatcaccagtcaggtccaggaagtggtccaggccgaggtcgccgcggcgcccgccgtggacaatgcccctgacatccaggccgtggcggtcaatcacgcgccgatcgtcgcgggcgtggccgacatcgggacgatcgacgaggatcatcccctgaccatgaccgccgcggaatggcaggccaagctgttggccaatgccacggattccgacggcgacaccttgtcgattctcagcctggacgatatccggatcgaccatggcagctttgcccggaatgccgacggcacctataccttcacgccggatgccaatttcaacggcgagatcaacgcgacttataccatttccgatggtcacggtgggcttgcgaccgggtcggcgtcgctgcatgtcaatgcggtgaacgacgcggccgagatcaccggcgacaccgccgtggtggtgggtgaggatacggcgcgggcggccggcaatctggacgccaccgacatcgattctccggccaccttcgtggcggcgacgacggcggatgattacggcaccttctcggtggacgagagcggccagtggtccttcgccatgaacgattccgtgcagtcgcttggggcgggtgaccacctgacccggaccttcgaggtccagacggcggacggcacctctcagacggtgacggtgaccatcgacggtgccaatgaccaggcggtgatctctggcgacgccaaggacctgtcgggttccgtcggcgaggacggcacccagaccgccaccgggactctccatgtctccgacgtggacagcggcgaggcccatgtccaggccaccagcgtcgagaccgaccagggcaccttcaccatcggcgaggacggcaagtggtcgttcgcgctcaacaacgacgacccggcggtgcaggccctgggcgccaatgattccatgaccaagaccttcacggtcaccagcgccgatggcaccgacacccaggaagtgacggtcaccatccacggcagcaacgacagcgccaccatcagcggcgacatcgccggcggcgtcggcgaggacggcaccggcacggccaccggcaccctcaacgtctccgacgtggacagcggcgaggcccatgtccaggccaccagcgtcgagaccgatcagggcaccttcaccatcggcgaggacggcaagtggtcgttcgccctcaacaacgacgacccggcggtccaggccctgggcgccaatgattccatgaccaagaccttcacggtgacgagtgccgacggcaccgacacccaggaggtgacggtcaccatccacggcagcaatgacagcgccaccatcagcggcgacatcgccggcggcgtcggcgaggacggcacttctacggccaccggcacgctcaacgtggcggatgtggataatggcgaggcccatgtccaggccaccagcgtcgagaccgatcagggcaccttcaccatcggcgaggacggcaagtggtcgttcgccctcaacaacgacgacccggcggtccaggccctgggcgccaatgagtccatgaccaagaccttcacggtcaccagcgccgatggcaccgacacccaggaagtgacggtcaccatcaacgggtccaatgactcggccaccatctccggcgacatcgccggcggcgtcggcgaggacggcaccagcacggccaccggcaccctcagcgtggcggatgtggataatggcgaggcccatgtccaggccaccagcatcgagaccgaccagggcaccttcaccatcggcgaagacggcaagtggtcgttcgccctcaacaacgacgacccggcggtgcaggccctgggcgccaatgagtccatgaccaagaccttcacggtgacctctgccgacggcaccgacacccaggaggtgacggtcaccatcaacggcagcaacgacagcgccaccatcagcggcgacatcgccggcggcgtcggcgaggacggcacttctacggccaccggcaccctcaacgtgtccgacgtggataatggcgaggcccatgtccaggccaccagcatcgagaccgaccagggcaccttcaccatcggtgaagacggcaagtggtcgttcgcgctgaacaacgacgacccggcggtccaggccctgggcgccaatgagtccatgaccaagaccttcacggtgacctctgccgatggcaccgacacccaggaagtgacggtcaccatccacggcagcaacgacagcgccaccatcagcggcgacatcgccggcggcgtcggcgaggacggcaccggcacggcgaccggcaccctcaacgtctccgacgtggacagcggcgaggcccatgtccaggccaccagcgtcgagaccgatcagggcaccttcaccatcggtgaagacggcaagtggtccttcgcgctgaacaacgacgacccggcggtccaggccctgggcgccaatgattccatgaccaagaccttcacggtgacgagtgccgacggcaccgacacccaggaggtgacggtcaccatccacggcagcaatgacagcgccaccatcagcggcgacatcgccggcggcgtcggcgaggacggcaccggcacggcgaccggcaccctcaacgtctccgacgtggacagcggcgaggcccatgtccaggccaccagcgtcgagaccgatcagggcaccttcaccatcggtgaagacggcaagtggtccttcgcgctgaacaacgacgacccggcggtccaggccctgggcgccaatgattccatgaccaagaccttcacggtgacgagtgccgacggcaccgacacccaggaggtgacggtcaccatccacggcagcaatgacagcgccaccatcagcggcgacatcgccggcggcgtcggcgaggacggcaccagcacggccaccggcaccctcaacgtctccgacgttgactccggcgaggcccatgtccaggcgaccagcgtcgagaccgatcagggcaccttcaccatcggcgaggacggcaagtggtcgttcgccctcaacaacgacgacccggcggtgcaggccctgggcgccggtgattccatgaccaagaccttcacggtcaccagcgccgatggcaccgacacccaggaagtgacggtcaccatcaacgggtccaatgactcggccaccatctccggcgacatcgccggcggcgtcggcgaggacggcacccaggccgcgaccggcacgctcaacgtggcggatgtggacagcggcgaggcccatgtccaggcgaccagcgtcgagaccgatcagggcaccttcaccatcggtgaagacggcaagtggtcgttcgccctcaacaacgacgacccggcggtgcaggccctgggcgccaatgattccatgaccaagaccttcacggtcaccagcgccgacggcaccgacacccaggaggtgacggtcaccatccacggcagcaacgacngcgccaccatcagcggcgacatcgccggcggcgtcggcgaggacggcaccagcacggcgaccgggactctccatgtctccgacgtggatacgggcgaggcccatgtccaggccaccagcgtcgagaccgaccagggcaccttcaccatcggcgaggacggcaagtggtcgttcgccctcaacaacgacgacccggcggtccaggccctgggcgccaatgagtccatgaccaagaccttcacggtcaccagcgccgatggcaccgacacccaggaggtgacggtcaccatccacggcagcaacgacagcgccaccatcagcggcgacatcgccggcggcgtcggcgaggacggcaccggcacggcgaccggcaccctcaacgtggcggatgtggacaatggcgaggcccatgtccaggcgaccagcgtcgagaccgatcagggcaccttcaccatcggcgaggacggcaagtggtcgttcgcgctcaacaacgacgacccggcggtccaggccctgggcgccaatgattccatgaccaagaccttcacggtgacgagtgccgacggcaccgacacccaggaagtgacggtcaccatccacggcagcaatgacagcgccaccatcagcggcgacatcgccggcggcgtcggcgaggacggcaccggcacggcgaccggcaccctcaacgtctccgacgtggacagcggcgaggcccatgtccaggcgaccagcgtcgagaccgatcagggcaccttcaccatcggcgaagacggcaagtggtcgttcgccctcaacaacgacgacccggcggtccaggccctgggcgccaatgagtccatgaccaagaccttcacggtgacctctgccgacggcaccgacacccaggaagtgacggtcaccatccacggcagcaacgacagcgccaccatcagcggcgacatcgccggcggcgtcggcgaggacggcaccagcacggcgaccgggactctccatgtctccgacgtggatacgggcgaggcccatgtccaggccaccagcgtcgagaccgaccagggcaccttcaccatcggtgaagacggcaagtggtcgttcgccctcaacaacgacgacccggcggtccaggccctgggcgccaatgattccatgaccaagaccttcacggtcaccagcgccgatggcaccgacacccaggaggtgacggtcaccatccacggcagcaacgacagcgccaccatcagcggcgacatcgccggcggcgtcggcgaggacggcaccggcacggcgaccggcaccctcaacgtggcggatgtggacaatggcgaggcccatgtccaggcgaccagcgtcgagaccgatcagggcaccttcaccatcggcgaggacggcaagtggtcgttcgccctcaacaacgacgacccggcggtgcaggccctgggcgccggtgattccatgaccaagaccttcacggtcaccagcgccgatggcaccgacacccaggaagtgacggtcaccatcaacgggtccaatgactcggccaccatctccggcgacatcgccggcggcgtcggcgaggacggcacccaggccgcgaccggcacgctcaacgtggcggatgtggacagcggcgaggcccatgtccaggcgaccagcgtcgagaccgatcagggcaccttcaccatcggtgaagacggcaagtggtcgttcgccctcaacaacgacgacccggcggtgcaggccctgggcgccaatgattccatgaccaagaccttcacggtcaccagcgccgacggcaccgacacccaggaggtgacggtcaccatccacggcagcaacgacagcgccaccatcagcggcgacatcgccggcggcgtcggcgaggacggcaccagcacggcgaccgggactctccatgtctccgacgtggatacgggcgaggcccatgtccaggccaccagcgtcgagaccgaccagggcaccttcaccatcggcgaggacggcaagtggtcgttcgccctcaacaacgacgacccggcggtccaggccctgggcgccggcgactccatgaccaagaccttcacggtcaccagcgccgatggcaccgacacccaggaggtgacggtcaccatccacggcagcaacgacagcgccaccatcagcggcgacatcgccggcggcgtcggcgaggacggcaccggcacggcgaccggcaccctcaacgtggcggatgtggacaatggcgaggcccatgtccaggcgaccagcgtcgagaccgatcagggcaccttcaccatcggcgaggacggcaagtggtcgttcgccctcaacaacgacgacccggcggtgcaggccctgggcgccggtgattccatgaccaagaccttcacggtcaccagcgccgatggcaccgacacccaggaagtgacggtcaccatcaacgggtccaatgactcggccaccatctccggcgacatcgccggcggcgtcggcgaggacggcacccaggccgcgaccggcacgctcaacgtggcggatgtggacagcggcgaggcccatgtccaggcgaccagcgtcgagaccgatcagggcaccttcaccatcggtgaagacggcaagtggtcgttcgcgctcaacaacgacgacccggcggtgcaggccctgggcgccaatgattccatgaccaagaccttcacggtcaccagcgccgacggcaccgacacccaggaggtgacggtcaccatccacggcagcaacgacagcgccaccatcagcggcgacatcgccggcggcgtcggcgaggacggcaccagcacggcgaccgggactctccatgtctccgacgtggatacgggcgaggcccatgtccaggccaccagcgtcgagaccgaccagggcaccttcaccatcggcgaggacggcaagtggtcgttcgccctcaacaacgacgacccggcggtccaggccctgggcgccggcgactccatgaccaagaccttcacggtcaccagcgccgatggcaccgacacccaggaggtgacggtcaccatccacggcagcaacgacagcgccaccatcagcggcgacatcgccggcggcgtcggcgaggacggcaccggcacggcgaccggcaccctcaacgtctccgacgtggacagcggcgaggcccatgtccaggccaccagcgtcgagaccgatcagggcaccttcaccatcggcgaggacggcaagtggtcgttcgccctcaacaacgacgacccggcggtccaggccctgggcgccaatgattccatgaccaagaccttcacggtgacgagtgccgacggcaccgatacccaggaggtgacggtcaccatccacggcagcaatgacagcgccaccatcagcggcgacatcgccggcggcgtcggcgaggatggcacctctacggccagcggcaccctcaatgtgtccgacgtggataatggcgaggcccatgtccaggccaccagcgtcgagaccgaccagggcaccttcaccatcggcgaggacggcaagtggtcgttcgcgctcaacaacgacgacccggcggtccaggccctgggcgccggcgattccatgaccaagaccttcacggtgacgagtgccgacggcaccgacacccaggaagtgacggtcaccatccacggcagcaacgacagcgccaccatcagcggcgacatcgccggcggcgtcggcgaggatggcacctctacggccagcggcaccctcaatgtgtccgacgtggataatggcgaggcccatgtccaggccaccagcgtcgagaccgaccagggcaccttcaccatcggcgaggacggcaagtggtcgttcgccctcaacaacgacgacccggcggtccaggccctgggcgccggcgactccatgaccaagaccttcacggtcaccagcgccgatggcaccgacacccaggaggtgacggtcaccatccacggcagcaacgacagcgccaccatcagcggcgacatcgccggcggcgtcggcgaggacggcaccggcacggcgaccggcaccctcaacgtctccgacgtggacaatggcgaggcccatgtccaggccaccagcgtcgagaccgatcagggcaccttcaccatcggtgaagacggcaagtggtccttcgcgctcaacaatgacgacccggcggtccaggccctgggcgccggcgattccatgaccaagaccttcacggtgacctctgccgacggcaccgacacccaggaagtgacggtcaccatccacggcagcaacgacagcgccaccatcagcggcgacatcgccggcggcgtcggcgaggacggcatcggcacggcgaccggcaccctcaacgtctccgacgtggacaatggcgaggcccatgtccaggccaccagcgtcgagaccgatcagggcaccttcaccatcggtgaagacggcaagtggtccttcgcgctcaacaatgacgacccggcggtccaggccctgggcgccggcgattccatgaccaagaccttcacggtgacctctgccgacggcaccgacacccaggaagtgacggtcaccatccacggcagcaacgacagcgccaccatcagcggcgacatcgccggcggcgtcggcgaggacggcaccggcacggcgaccggcaccctcaacgtctccgacgtggacaatggcgaggcccatgtccaggcgaccagcgtcgagaccgatcagggcaccttcaccatcggcgaggacggcaagtggtcgttcgccctcaacaacgacgacccggcggtccaggccctgggcgccaatgagtccatgaccaagaccttcacggtcaccagcgccgacggcaccgacacccaggaagtgacggtcaccatcaacgggtccaatgacggcccggtggtgagcggccccgtggatctcggcgcgaccgccgaggatcactccatcaccttcacggcgcagcaattgctgggccatgcctcggacatcgatggcgacagcctgtcggtgagcaatctcagtgccggtaacggcaccatcagccagaatgccgacggcagctataccttcacgcccaatgccgacttcaacggcgaggtcaacgtgacctacaccgtgtcggacgggcatggcggcaccacttcgggttcggccagcttcgacgtgacctcggtcaatgacggcccgaccaccagcgatgtgacgctggcctcggggaccgaggaccgctcggtgaccatcaaggccagcgacctgctgggcaacgcccatgacgtggacggcgataccttgtcggtgtcgaacctgtcggccagcaacggcaccatcaccgacaaccatgacggcacctataccttcacgccgaaccatgatttcagcggcaacgtcgacctgtcctacacggtcagcgacggccagggcggcagcacggcgggcacggcccatttcggcatggccgcggtggcggattcgccggtcctgtcggcgtcgaacattaccgtcgacctgggagccggccaggctcagaccctgaacggcaccaccggcaacgacaccctgagcggcggttcgggcaatgacgtggtcaacggctcgtcgggcgacgacgtgctgtatggcgacggcaccggcagcgtgacggttccgctgaacatcagcgaccgcctgagcgacaccgacggttcggaatccctgggcagcgtgaccatcggcggtctgccggccggggcgagcctgtctgcgggcacccataattccgacggcacctggactctgactccggcgcagctgacgggcctcagcgtgaccaccaccgagggcaccgccctgcatctgagcgtgacggcgacctcgaccgaggcgtccaacggctcgaccgcgaccaccaccaccagcttcgacgtcagcttcagcggcacggccgccggcaatgacaccctggacggcggggcgggcaacgacaccctgttcggcggggccggcaacgacaccctgacgggcggcgcgggcgccgacctgctggagggcggcgacggcaacgacgtgctgaactactcgaccgacgggacctggagcggcggtttcgtgtcgcagaacgtgggtgataccacccatgcgggcaccaacgagacctataccatcaccggtgacaacgacagccaggacgtgttccgcggcggcgccggcaccgacaccctggtgatgggctcgggcaatgacgctctgttcctggacgacggctatagcggctcgcccaccggcggcgcgcgcatcgacggcatcgagagcattgtggccggcgagggcaacgacggtggtcgacctgacgtcgagcaagtacacctatggcgacgtcaccatcgacggcggcgccggcaacgacgtactgatgggcaatgccggcaacgacgtcatcgacggcggcaccggcaacgacgtgctgtatggcgcttcgggcaacgatacgctgcggggcggcgatggcgccgataccctggacggcggctatggcgccgacaccatcgacgcgggcgccggcaacgaccttggcatcatcaagggcggccagtcggcgggcgacaattacgacggcggcaccggcaccgacacgctgcgcatcgacctttccgggtcgcaatacaccgcggcggtgcgcgccgagctgcagcagttccagtccttcatcgccgatccggcccatgccggccaaagcttccacttcaacaccctgggtgttgacgccaagaactgggaaagcctgaagctgacggtggacggccgcgacgtctcgctggagaacgctccgacggtgaccagcgccacggcggtgagcaccgacgaggatcattcgggcgccggccgcgtggtcgggaccgaccaggacgtgggcgacagcgtgcgctaccacctgatggatgccagcggcaaccaggtggacagcctgtcgaccgcccatggcacggtgaccatcaactcggccaccggcgagtacaccttcacccccaatgccgacgcgcagagcctgcgggctggcgacgtgcagaccgacagcttcaaggtcgtggccaccgacggcaccatgaccagcgcgccctcgaccgtgggcgtcaccatcaccggcagcaatgacggcgcggtgatcaccggcaccagcgtgggcacggtgggcgaggacggtaaccgctcggtgaccggcacgctcaacgtcgccgatgtggatcaggggcaggcccatgtgaccgcccagacggtgcagaccgatcagggcactttcagcatcggcgagaacggccagtggaccttccaggtcaactcgggcaatgccgacgtgcaggccctgggcgccggcgagtccatgaccaagaccttcgccgtggcctcggccgatggcaccgcacccagaacgtgacggtgaccatcaacggcgccaatgactccgccaccatctcgggctcgaccaccggcgcggtggccgaggacggcaacggccgtgccaccggcaccctcaacgtggccgacgtggatcacggtcaggcccatgtgaccgcccagacggtgcagaccgatcagggcactttcagcatcggcgagaacggccagtggaccttccaggtcaactcgggcaatgccgacgtgcaggcccttgggggccggcgagtccatgaccaagaccttcgccgtggcctcggccgatggcaccgccacccagaacgtgacggtgaccatcaacggcgccaatgactccgccaccatctcgggctcgaccaccggcgcggtggccgaggacggcaacggccgcgccaccggcacgctgagcgtcgccgacgtggatcacggtcaggcccatgtgaccgcccagacggtgcagaccgatcagggcaccttctccatcggcgagaacggccagtggaccttccaggtcaactcggccaatgccgacgtgcaggccctgggsgccggcgagtccatgaccaagaccttcgccgtggcctcggccgacggcaccgccacccagaacgtcagcgtcaccatcaccggctccaatgacggcccgacggtgagcggcgcggtgggtctcggccacacggccgaggacaattccgtcaccttcaccaaggcgcagctgctggccaacgcccatgacaccgatgcccacgacaccctgtcggtgagcaacctgtcggcggcccacggcagcatcgtcgacaacggcaacggcacctacaccttcacgcccaccgagactttcagcggccatgtggatgtgagctataccgtcagcgacggccatggcggcaccaccaccggttcggcggcgctggacgtggacgcggtggccgaccgggccacggtgtcggtggccatcggcgccccggtggagacccccaacggcagcttcaccgtcaccaatttggacagcacggcctcggccggctacaacaacacctatggctattacgtcatggacgacagcggcaacccgacttcgggtggcgtgatctggtccaacgtgcatgcctcgcccggcgcttcggtgaccatcagcggcgtcgatcccgaccgggtcggcttcttcctgatccccgacggcggcagccagaattccggcctggccaatggcgcggcgctgaccttctccaaggatgcgtcgggcaactggcaggccagcgacagcgccggccacgtgctctcgggcgccgggaccaaggtgctgttcgacaagagcgcgctcaacggcgaccacatggtccatagcgaggacaccagcgcggtgtcgggcaaccagaactgggaagacctgaccggcggcggcgaccgcgactacaacgacgtcaacatgtcggtgacctggggcaatgcggcgccgacggcgacccatccgctcaccgtctcggccagcttccccgacatggacggctcggaaggccatgcggtcaaaatctccggcctgccctcgggctcgaccctgtatcagaacggcgtggccctggtggccggcgccgacggctcgtactccctcaacccggcccagctgggcggcctgtcggtcaagactccggccggcttcaacggcgacctcaacgtcaacgtgacggcggtggccaccgacggcaccagcgtggcctcgtccaccgcttcggccaccgtgcatgacgacctgtccaaccacgggccggatgcgggcgacgccacctcggtgcacggcgccatgggcgccaccatcaccggcgcggccggcgtcaccgattccgacggcgaccacctgtcctatgcggtgggcaccggcaccagcggaccgcagcacggcaccgtggtggtcaacaccgacggcaccttcacctatacgcccagcggcaattacagcggcaccgacaccttcaagatcaccgtgtcggacggccacggcggcaccgccaccgagaccgtcaacgtcaccgtggagaacggcgccccgacgctcaccaccgccaacgcggcgacggccaacgatcacagcgccgtcaccggccacgtcaccggctccgacacccccggcgacaccctcagctactcgctggtcgacgccaacggcaaccatgtcggcagcctggtcaccgaccacggcaccgtcagcatcaacgccgccaccggcgactacaccttcacccctaacgccgccaacgccagcctcggcgtcggcgcctcggtcaccgacagcttcaaggtcgtcgccaccgacaaccacggcgccgacagcaacctcggaaccgtcgccgtaaccgtcacaggaagcaatgacgggccggtggtgaccggggtgaccggcggtaccggcaacgagagcatcaccagcgcccgttccgtggtgaccggccatatctcggcgggtgacgtggatgccggcgacacgctctcctacagcgtcaccgacaacgccgccgccggccatcacggcactctggcggtcaacgccagcggcgactacaccttcaccgcctcggacagcaactggcacggcacggacagtttcaccgtccaggtgtcggacggccatggcggcacggtcaaccagacggtggccatcaccgtcaatgcccaggccgacgcggcgaccatcaatgcccaggacgccagcatggcggcgcagtcgggcgcgactttcaccgccagcggcggctatgccgagggtggttcgggctcggacatcatcaacggcagcagcgccaacgatatcctgtacggcgacgacccgtcgggtgacaccgaggtgacggtcgccctcaacatctcggccgcggcgatttccggtgaatcggtgtcctccatcaccctgtcgaacctgccgggcggcgcggtcctcaaccatggccacgacaacggcgacggcacctggaccctggctcccggcgatctcaccggccttaccctgacctcgaacaacggcataggcggcaccgtcgacgtggcggtgaccaccctggacggcaccagcacggcggtgaccaacagctcgttcaacgtctcgttctcgggcgggttcaacgacaccatcaccggcggcgtcggggccgacaccatgtatggcggcgcgggcaacgacaccttcaaggtgtcgggcgccagcgagagcaccggcgacatctatgacggcggttcggggacggataccgtcctgggcagctcgggcaacgacgtcatctcggtgaccagcaatctcggcaacatgcgctccatcgaggtgatcgacggcggtgccggcaccgacaccctgctggccgggtcgggcaacgactatctcgacttctccggcaccaccatccgcggggtcgaggtgatcgataccggcgccggcaacgacgtgatcaccggctcggccggggcggacaccatcctgaccggcaccggcgacgacaccgtggtggccatcggcggccagacggcgggcgatgtctatgacggcggcgccggcacggataccctgaacgtcgacctgaccccggcccagtacaccacggcggtgcggctggaactgatgagcttcgccagcttcgtcgacaacccagccaatgcgggcaagagcttcaccttccagagtctgggcggcctcaaggccaccaatttcgaggatctgcgggtgacggtggacggcaatgacgtcgacctcaaccacccgccgcaggtgaccagcgtcgaaagcaactataccgccggccatgccgacggcgtggtgcacgccaccgattccgatggcgacaccatgagctactcgttcggcaccaacaccaacgggacgcccatcacctccatggcgacggcgcacggcaccgtcaccatcgacagctcgacgggcgagtaccacttcaccgcctcggatgccaacttcaagggcaccgacactttcagcgtcaccgtcaaggacggcatgggcggcaccaccacccagaaggtcaacctggacttcaatccgggcgacgacgccaccgtggtcaccggcccgaccagcctgggcggcagcgacgaagatacccagaccttcatccgcaccgaccagttgctggccaacgccaccgacgtggacaataccctgcatgtggccaatctgtcggcggtggattcccacggcgccgtggtgggaagcttcgtgcacgccgtggatgcggacgggcatgatggctatgccttcacccccaatgccaatttcgcgggcgatgtcaccgtcaattacgatgtggtgaccgacacgggcatcgccacccacaccagcggttcgctgcatgtggatgcggtggcagatgcggcgaccttcgatgccaccatcggctccaacggcgtctcggtggcccatctgggcaatgacagcaaggtggtcaacctgttcgtcaacgacaccagcagcggcaccgccggcttcgacatctacctgggtggcaccaatatcggccactacacggtggggcgcagctatagttccgacaagtcggtgtcgctgaccctgaccgacgcgcagcacacccagttgctgaacggcgccgacatcaagatcgtggacaatgacggctacaacactcgcgacgtcctggtggacaggatccaggtggacggcctgaccttccaggcggaaaacggcatcctgtcgggggccagcaccaccagcggctattacggcgtctccagcgagacctatgcccgcctgaacaacgtgggatcgtcggtgaccttcgacttcgactcgtcggtcagccatacgtccagcggctatcatgtggatctcgccgggcatctcaatgataccgacgggtccgagacgctcagctatcacatcgatgccatgaccaccggtgcgtccctcagctacaccggcaacgagggcaccctggtccacaacaccgacggcagctgggacttcaacgtcgacgcctcgcattacgacggcgccgtgtccctgaacctcaacgtggccaacggtaccgccggtttcgatgtccacgtcaccgccaacgccaccgagacctccaacctggacgtggccggtgtcggcgataccgtccattgcgacggcgccatcggcggggccggcgccatccccggcatcaccctggtgggcaatgccggcaatgacgacatcatcggcaccaacggcaacgacctgttgctgggcggcaagggcggcgccacctaccgcttctcgggcggcggttgcggctcgggcggcggctggtccatcgtccagtccgacaccaacgacgtgatcagtgccggagccggcgacgacgtgatctacggcgacgccaggctggtgaacggcaacatccagatcaccggatcgggcaacgacgtcctcgatggcggatcgggcaacgaccagatccatggcggtgccggcaacgacaccatcatcggcggcaccggcgacgatgtgatgttcggtgaccagggcaacgacaccttcctcttcgacttcggcttcggccatgacgtggtggacggcggccgcggctccaattggaccgataccctggatctcacccatgacaaccagatatcgtcggtcaacatcgagggtgtgtcgggctgggcggtgtcggtggatgcccagggccatcacgtggcccaggccaccaacggcgcccacgatgccaacggcaccatcgtcgtcaccaatcacgacggcagccaggacaccatcgagttccacaacgtggaaaaagtggtctggtagtcccaggatcggggttaggatcgggggccgtcctgcggggcggcccctttttcatgggagagcggccagggtggcgagcatcgggcgatatacggtcatccggcccttgatcgagacggccttttcccgcctgatcctggcctcggacgaagcgctggggcgcccggtggtgatcaagatcttcgccgtggacctcgccaggcccgagccgccgttcagccggagcgaatggctggggcgcttcgtcgccgaagggcggatcatggcctccctggatcacatcaatgtcctgccggtgcacgagatcggccgccagccggacggcacgccctatctggtgctgccgttcatgcgggctaatctgccgcgcctgatcggctttgacacggacgagccggggatggccgaggacgagcggccgcagcgtctaggtcatgcggtggctctgcccatcctgtttcaggtcctgtcggccctggcctatcttcatgggcgcgggatcattcaccgcgacatcaagccggccaatatcctgctgaccgcgcgtcagggcggagtggccaagctttgcgatttcggcatggcgcgacggggcgtcggagcagatgccgcgcccagggcgtggttcggaaccctcgactacatcagcccggaacagcgcgacggcaccggagcggtcgacgggcaggccgacgtgtattccacggcggccatggcctatcgactgctgggcgggcgattgccgggggatgagagccgtccacccttgccggagcttgcgcccgacctacctgccggcctgcgtgactgggtcgccgcagccctcgatcccgacccggccaaacggccgaccgccgaacaatcggtcctctggatccggagccttctggggcggtagagggccgccgacgaccgtatcgggtcttatggcccggcccatccggggcgagggtcccgtttttattccaccgtgacgcttttcgccagattgcggggctgatccacgtcggtgcccttggcgacggccacgtgataggccagcaactgcaccggaatagcgtagaggatgggtgcgaccaccgggtcgacggagggcagggccatggaggagaagaccttggccgacaggcggtcgatgccttcccgatcggagaagaacaccacgcggccgccgcgggccaccacttcctggacgttgctggccgtcttctcgtaaagctcgtcggtcgggcagatgacgatgaccgggaccgaatcgtcgatcagcgcgatggggccgtgcttgagctcgccggcggcataggcctcggcgtggatatagctgatttccttgagcttcagcgcgccttccagggcgatgggatagccggtgccacgcccgagatagagcacgtcgcgggcctcggcgatgccctgggcgatgacgcggatgtcgtcgtcgcgccgcagcacttcggcgatgcgggcggggatttccgacagcgagcgacagatatcggcctcggcctccgccgacagggcgccggtggcgcggcccatgccgatggccaggcaggccagcacagtcagctgggtggtaaaggccttggtcgacgccacgccgatctcggggccggccatggtcagcagggcggcctcggattcgcgggcgatggtgctttccggcacgttgaccagggacagggtgtgctggccatgctcgcggcaatagcgcagagcagccagggtgtcggcggtctcgcccgactgggagatgaagatggccaggccatcggcctccatgggcgggcagcggtagcggaactcggaggcgatatccacttccaccggcaggcgggccagcttctcgatccagtacttggccaccgaaccggcgtagaacgaggtgccgcaggcgatgatccgcacccgcttcaccgccgccagatcgaagggcagccggggcagggtgatggtgcggtcggccgggttcagcatggtgttgagcgcgttgctcaccacttcgggctgctcgaagatttccttgagcatgaagtggcggtgctcgcccttgccgatcatggcgcccgagaactgggtctggcgcacctcgcgggtgacggtggcgccggtgcggtcgcggatgaccacggtctcggcggtcagcaccgcccagtcgccatcgttgagataggcgatcttctgggtcagcggcgccagcgccagggcgtccgagcccagatacatctcgcccgcgccatagccgatggccagcggcgagccctgccgcgccgcgatcatcatgtcgggccgcccggcgaagacgatgcccagggcgaaggcgccctgcagacgctccagggccttggcggtggcgtcctcggcccccatgccctgggcgagatgatagtcgatgagctgggccactgcctcggtgtcggtgtcgctctcgaacacctggcccttggccgacagttcggccttcaactcgtggaagttctcgatgatgccgttgtgcaccaccgccacccgcttggtggcatgggggtgggcgttgcgctcgttgggcacgccgtgggtggcccagcgggtgtggccgatgccgatcagcccgcccaccggccgggtcttcagcagggcttcgagattggccagcttgccttcggcgcggcggcgctcgatctggccgtccaccagggtggcgatgcccgccgagtcatagccgcgatattccaggcgccgcaatccctccaccaggaggggggccgcttccactttgccgatgattccgacgatgccgcacatggcgtctagtccttcttcgctttcttggcggcttgctgggcgcggaagcgctcggcccagcccttcagctccatctgcgagccgcgcgccaccgccagcgcgcctggagtcacttccttggtgatcaccgagccggcgccgaccacggcaccgtcgcccaccttcaccggcgcgaccagcgaggtgttggagccgatgaaggcccccgcgccgatatcggtgaacgacttgttgaagccgtcgtaattgcaggtgatggtgccggcccccacattggcgccggccccgacgcgggcatcgcccacataggccagatggttgatcttggcgccggcttcgaccgtggccttcttgacctcgacgaaattgccgatatgggcgccttcgccgatttcggcgccggggcgcagccgcgtgaaggggccggcggctacgcccgcctcgaccatgcagccctcgaaatggcaaaagcccttgatctccacgttgtcgcccacggtgacgccggggccgaacaccacatgcggccagatggtgacgtcgcggccgattttggtgtcccacgagaaccagacggtggcggggtcgatcagggtggcgccgttatccatggcggcctcgcgcaggcgggcctggaccagggcttcggccaccgccagttccgatcgggcgttgacgcccagcagctcggcctcgtcgccctccacatgggtgcaggtggcgccgtcggcgcgggccagggcgacgatgtcggtcagatagtactcacccttggagttcttgttgtcgacccgctcgatcaggctccagagacgattgccgtcgatggccatgacgccggaattgcacagcggattctcgcgctggtcgggggtggcgtcgcggtattcgacgatggccttcagcccttcggcacccaccaccaggcggccgtaatggccggggtcctgaggcttgaagcccagcactaccaccgccgggtcacggggaccccggcgctcggccagcatgcgctccagcgtggcgcgggtgatcagcggcgtgtcgccgtaaagcaccagcacgtcgccgtcgaactgccccagcgccgccttggcctgcaacacggcatggccggtgcccagccggtcggcctggatgacagtggggaagggggcgacggtcttgccgaccagctccatgtcgggtccgaccaccaccaccatgcggtcgggcgaaagccccgacacggtgtcgagcagatggctcaccatgggccgtcccgccagcgggtgcatcaccttggggagcgacgacttcatgcgcgtgcccatgccggcggcaaggacgatgacggcgagcttgctggaagccatgatgcgggctggacccaatctgttgcggttgtggccggaaggtgccacaaaaggcccgagtgggccaagtcaatctttgtttcggaaggtttcaatgggcatgggattgcaggcggtgctgttcgacctggacggcaccctgattcattcgcttcccgatctggtggcggcggtcaaccggttgctggcctccgaggggcgaggggctctggacgaccgtacggtgatgtccttcgtgggcgacggagcggggacgctggtgatgcgggccttcaccgccaccggcggcatgccgggcccgaaggtggagccttacctcgatcgtttcctggccgattacgagccgcgctcggcggagagcacccggccttggcccggcgtgccggagaccctggcggacctgaaggcggccggcctgacccttgccgtgtgcaccaacaagccgtcccgcgccaccgccgagattctggcggccttggacctggggcgctggttcgacctggtggtgggggccgatgacgctccggccatcaagccagatcccgcgcatgtcacctgcatcctcgaccgcctgggcgtggccgccgaccgggcggtgatggtgggggattccgccaacgacatcgtgtcggcgcgggcggcgggcgtgcgcagcgtggccctctccttcggctattgccacgggccggtggccgaattgggcgccgactgggttatcgatgattttcgccagctttcccccttgctgctgggccggcggccgccggtttcgtgacaattcgatgcagcgccacggcctcagccctcttgcgttgaaagtggttcgaggccatgctccttgcagccgttttttgggggcaccgtggtcgaggctaaagggaaatcgccgcagcggcgggtggaggagctgtcgcagcaggtggagcgtctctcgctctatcaggccgtgttcgataatgccttcgaaggcatgttcgccaccgatgccgccaatcgcatcatcgcggtcaatcccgcctttaccgccatcaccggctatgcggccgaggaagccatcggcaacgatccgcgcatgctcagctcgggcttccatgaccccgccttctaccaggagatgtgggatcagctttccacgaccggccaatggcagggtgaagtcgtcgaccgccacaaggacggccgtccggtgcggctgtggctgtccatcacctcccagcgcggcgccgacggcaaagtggcgcgccgtatcgccgtattccgcgacgtcaccgaggcgcgcgagaccgcagaacagctttggcagcgcagcaatttcgacccgctgaccgaattgcccaaccgcaacctgttcctcgaccgcctgctgcaggccctggtcctggcgggtcgcgagggctccaaggtggccatgctgttcatcggcctggacggcttcaagaacatcaacgattccctgggccactggatcggcgacaaggtgttgcaggaggcggcgcgccgcttccagaactgcctgcgccagggcgatacggcggcgcgcttcggcggcgacgagttcaccgtggtgctgtcgggcgtgcgggccaccgccgaggtggaggcggtgatccgctctgttctggaggtgctgcaggagcctttcgtggtcgagcatcaccacatcctgatctcgtgttccatcggtgtctgcatgtggcccggcgacggcgaggacgtggattcgctgatgcgcaacgccacggcggcgctgcagcaggccaagcaggccggccgcaacaccttccgcttcttcactccagccatggacgctcgcgcccaggcccgctcgcgcctggcggacgagctgtccggggcattgtcccagggcgagttccatctggtgttccagccactggtggacgtgaagtcgggcaaggtcaacgcggccgaggcgttgctgcgctggcacaaccgctatctcggtgtggtcagccccgaccagttcgtgccgttggccgaggaaatcggcctgatccgccccatcggcgaatggctgctgaccgccgcttgccgcgaggcgctggtctggcagggcatggggctgggcgagatcaatatcgccgtcaacatttcgccgcgccagttccagcagggcgacatcgtcggcatcatccgccgcgccctggaagacactcgtctgccgccctggctgttgaccatcgagatcaccgaggggctgctgctgtccaacggcgaggagatcctggccaagatggaggccatccgcacgctgggcgtcagcctgtcggtggatgatttcggcaccggctattcctcgctgtcctacctaaagagcttcccggtggatgtgctgaagatcgatcgctcgttcatcgccgacatgggcgatcacagcgacgacgccaccatggtcgaagccatcatcgcgctgggccactcccttcatctcgaagtggtggccgagggggtggagaccaagcagcagctggacttcatcaccgcccagggctgcgacgtggcccagggctattacttctcgccgccgctcagcgggccgcggttccgcgagttcgtgctcgaacgcctgggcctgcccgagcccgaagggatggccggcgtggcgccccacggtgtccgggtgctgttcgccgatgatgtggaactggtacggctggtgtttcgcgacttcctcgaaggcaccggctgcgttatcgacgaggccgccgacggaacccaggccatcgccaaggccaccgccgtgcgcaaggacggaggcaaccggcaccagttgatggtgttcgatctgtgcatgcccggcgtggatggcttcgaggtggccagggccgtccggctgttcgaggccgccaaccacctggacccggtgccgctgatcgcgctgaccgtcgacgattccgaggagagccgggagagggcgcggcaggccggattcgaccgctttctcaccaagcccatcgcccggtcggaattgctggccgccatggccgagatgctgccggccgccaataccgacatggctccggccgatggcagcctgaccgccggactgaacattcccaccggtctcgagcatctgctgcccaccttcatggccgagatgctcaaggaccagcagaccctgcgcagcctggccgaggggcgggaccgcgctgccctggccgatcatgcccatgccatgcgcggcaagtgcggcatgttcggcgaggaggtgctctactcgctgctgggggatctggaaagcctggcgccgctgggcgaccggggggaaatcacccgtctggtcgccaaggtcgttgaacgggtcggccgcctgtagcaccatggatcccgatccgggacccaggggcggggcacaatgaagatcactcagttcaccgacttctccatccgtttgttgatttatctgtcgcggcatcccgaccgggtggtgacggtgcgcgaagtggccgagtattacgatatctcggccgagcacctgaaaaagatcgtccgctccctggccgagctggggcacatccagaccgtgcggggcaagcatggcggcctgcgcctgggccgcgagccccaggccatcgatctcggccatctgttccgccagcaggagaatctggccctgctgccctgtcacgagccctgcgattcctgtcccatcgccgattgccgcctgcgcggcctggtcgacagcgccctggcggcgtttctggccgtgttcgacggcaagaccctggcggatgtgatctagcgggggcatttgcctgtcatcccgacgacctgggggaggagggatctcgtcctggtccggcgtctcggaataggcaccgccatgccaagcggagatccctcgctctcgctcgggatgacgacggaaaatgtgatctagccggccaccggcgcccacagcacgtcgtcgatggtctccgtccccgccagcagcatcaccagccggtcgaagcctagggcgatgccggcggagtccggcatgcccgcgtccagggccgtcaggaaatcctcgtccaggggatagcgctcgccgtacagggcctgcttcaggtccatgtcggcggtgaagcggcggcgctgttcggcggggtcggtcagctcaccgaaggcgttgcacagctccacgcccagggcataggcctcgaagcgctcggccacccgggggtcggcgggcgaggggcgcgacagcgccgccatggagaccgggtaggaatggaggatgaccggtcggtcgaagccgagatggggctcgacccggtccagcatcaccttgaagaagatatcctcccaactgtccgacgggctgaccgagaggccgatgcgcgccgcctcggtggccaggaccgaccggtcgggcgaccaagggtcgggggcactggccagcacgtcgatgccggcgtattcggcaaaggcctcggccaccgacagccgccgccagggggcgaaggggtcgcaggtggtcccccggcgccgcaacaggccgacgccggcggccttggcgcaatctcggaccagggcctcggtgtcggccatcagatcctcgatggaggctccggcccggtaccattccagcatggtgaattccgggtgatgggtggccgagcgctcggcattgcggaaaaccttggccagctggtacaggcgcggcacgcccgccaccagcagcttcttcatggcgaattcggggctggtgtgaaggtaaagcggccggtccggcccgccgaagggatcggcaaaggcggtggcgaaggccttgagatggggctccaggcccggcgagacctgcagacagggagtctcgacctcggcgaagtcgcgggcggcgaagaaggcgcgggtggcgttgaccacgcggccgcgcaggtccagggccgccttgcgccgggcgaacacctcgggtcgccaccattctttacctgccatggccttttcctctatctagggaccccatgtcgagccgccgaaccctacgcaccgcccaagacctgcatgacgccgggctgatcccgtccgtcgaggcggtggccggcgtcgccgaggcctacgcggtggcgctgacgccggcggtggtggatctgatcgatcccgccgacccggccgaccccatcgcccggcaatacgtgccctcggccgaggaactggtgaccacgccggaagagctggccgaccccatcggcgacgcagcctacagcccggtgaaggggctcgtccaccgctaccccgaccgggtgctgctgacgccgctgctggtctgcccggtctattgccgcttctgcttccgccgtgcccgggtgggcgatggcgacgccaccatgaccgaggcggagatcgataccgccctggcgtatgtggccgggcgcccggagatccgcgaagtgattctgaccggcggcgatcccctgatgctgccgcccccgcggctggcggccctgctgggccgcatcggagccattgcccatgtggagctgatccgcatccattcccgcgtgccggtcagcgacccggagcgggtcacgcccgatctggcgcgtgtcttgggcggaggcgacaagccggtgtggctggcggtgcacgtcaaccatccgcacgagttgtcgcccctggcgcgcggcggtctggagcgtctggcccgcaccggggtgccgctgctgtcccagaccgtgctgctgaaaggcgtcaacgacagcgtttccgtgctggacgagctgttccgcgccctggtgcggaaccgggtgcggccctattatctgcaccatcccgacctggcgcccggcaccagccacttccgcccgaccatcgaggaggggcaggccctgatgcgcagccttcgcggccgactgtcgggcatcgcccagcccacctatgtgctcgacatccccggcggcgcgggcaaggtgccggtggggccgcaatactgggatggggaggctgggacggtggccgatcccggtgggcgtctccatgattacgcggagcgcgcttagggtctgcggaagacggcgtagaatccgggatagcggcggtgcaagcgcagggagatcgagatcgtctcgaggccggccgcctcggccgccgccaaaaggtatgcccggctgtgtgcaaatccgccgaccccggaaactccacgatggctccggtcggtggtggcctccgtagagaatatgagatatccgccagagcgcagccgccgtgcggcgttgctgatgaacggcctcagatcctcgatgtgatggagggccgcgctgctgaccacggcatcgaacggcccggccggtacggcggtgtccgaactggcgtcggcgaccgtcaggctgtcatagacggaccttgcccgcgccaggtccagcatctccgccgacaggtcgaaaccgctcagatacttggtccgggggcgcaggaatgtgcccagcagtccggtgccgcagcatgcgtcgaggatgctggcgacgtgtgcgggcagatgggcctcgatgaccgacatcatcatatcgttacagccgcgatgcagggaattgtcgtcgtaagtcgcggccaggtcggcgtagttcgtctcggatggcggcggcggggacgtgacttccaacgcggaaccggcccgtccgagcatctcgacggcatcatcgtcggcgccgccgcaatgtagaatgtaggccagcccaaggtagacggccggcatctgctcgggcggaatcgagcgctgtccggccgccagcatgtccatcaggcgatcgccgggctttgtaccgattcccgcgacgagggttcgacaggcggcgaacggaggggcggagatggccgtccgttcggtggcggcgatcatcaggtaaagggcctcgggaagcgatttgccctctgccgtcacgatggcatcggcggccaggagaaagagtccgggaatgtctccggccgtgaacagcgccccgcaaagagccgatttcaaatcggaccggtgcggcgccgtcccgacggccctgcgcatacgctcgatgccgggaccaatttccccggtgcgaagatgcacatggcccctcaggaacagggcgtcgggatggttgggcgaaatgccgagaagtttggtcaagagatcggcggcctgattgaacacgccctgctcgcacagccgcgccgccaggtgaagcccctggtcgaacgtcatttccattccgaagcgccccaaaactggaatttgaaatgaagaatatccggcggcaatctttgagggtatgcgtaatcttacggttacgctgaaaacactcattgatctgcggcgcatcaatcggtccggtttcccagtttcgccggaatgacgggtattcttgccttcccgcagtcgacctgatagggtccgcgccaaatttccgtcagccctgttggaactcccatgaagatcaatgccaacctgattcgtcccggcaacatcctggaacacaatggccgccagtacgcggtgctgaagactcagatcgtccagcccggcaagggcggcgccttcatcaccgtcgagatgcgtgatatccgcaccggcaacaagaccaacgagcgctggcgcaccgccgacaccatcgagaagtgcaacgtcgaggccaaggagtgcacgttcctgttcaaggacgactccaacatgaccttcatggattccgagagcttcgagcagttcaccatgcccaacgacaccctgggcgacaccatcggcttcctgcaggacggcatggtggtcgaggtggacttcgtcgagggctcgccggtctccatcaccctgccggaaaaggtggtgatgaaggtggtcgaggccgatccggtggtgaagggccagacggcgtcgtcgtcctacaagcccgccaagctggaaaacggcatgaagatcctggtcccccccttcctggaagagggcgaggtgatcatcgtcaacaccaccgactgttcctatgtcgagcggttcaagggctagccggtgatcattcgctccgcactgctgaacgtcatgatgggggcggcccgcaaggccgcccgcaaccttgtgcgcgattacggcgaggtcgagcacctccaggtgtccaagaagggccccgccgacttcgtgtcctcggccgacatcaagaccgaaaagaccctgcgggccgagctgaagaaggcccgtcccggcttcggcttcctgatggaggaaggcggcgagatcgctggtgacgacaccagccatcgctggatcatcgatcccatcgacggcaccaccaacttcctgcacggcattcccaatttctgcatctccatcgcgctggagcgggacggcgagctgttcgccggcgtggtctaccagccgctgggcgacgagatgttccatgcggaaaagggcgccggcgccttcctgaacgagcggcgcctgcgcgtgtcggcccggcgcaagctggaagacaccctgatcgccaccggcattcccttcatcggccgtcccggccacgagaccttcctcaaggaactgggcgccgtgatgccccaggtggcgggcatccgccgctttggttcggcggctctcgacctcgcctatgtggcggccgggcgctgcgacggctattgggaaaccggaatcaagccgtgggacatcgcggcgggcatcgtgctggtcaaggaagcgggcggctacgtcaccgacttccagggcggctcgaagatgctggacaacggcgaggtcctggcggccaatgaccatcttcaccagccgctgatgaaactgctgaagacggcgcggggatagggttgtggccggactccggttcggctagattcctgaccataagaataccgagggaattcagccgggagagtggcgtgatgagcagggggagaaaggtcgcgttgctggcgctgggagcgcttgtttccgtcgcgtccatgcccgcatccgcccaggtggtggtcggcgagtaccgacccagcgtcgacgtcaactgggacgttctggaccggctggggccggagcccaccctgcccgggctgatcacccgcccgccggcggcggcgacaccggctgttccgcgcccggcggcgcggcctgccgccgcccccaaggcgaccgcgttcaagccctatgccgagtcccaggccgctcccaaggtggcggcgcccaagcctgccgcgcccaaggtcgaacgggtggtcgaggcccccaaggtgaccattcccgccgccgaggcgcccaaggctcctgaacccgccaagatcgtcgcggcccccaaggccgtcgagacacccaaggtcgtcgaggctcccaaggcgaccgggccggcgcccaagcccgccaagccggagatcgccgccgacgtgccgcctccggccaaggtcgaagcccccaaggctcccgccaaggccatcgagactcccaaggttcccgaacctcccaaggtggtcgaggtgcccaaggcccccgagcccgtgaaggtcgaggcgcccaaggcccccgagcccgtcaaggtggtcgaggcccccaaggctcccgagcccgtcaagatccccgaaccggtcaaggtcgtcgaggcgcccaaggcccccgagccgcccgccgcggttcagttcgccaaggccccgccgccggtggccccggtggctcccactccggtggtccccgtcccggtggtgcaggctcccgtggcgccgcccctgccggtggctccgccgcccgtggtcgtggcgccgccgccggtcgtcgctcccgcgccgttgccccagatcgccgccttgccgcccgccgcgccggctccggtggccgctcccgtccgcaagggcgacaatctgacggtgccgttcgccaccgacagctcccatctgcccgagacggtgcggatcgagctggatcgcctagcccagcgcatggacaaggacgagaacctgaatctccagttgctggcctatgccgccggtgacgaggccaatgccagcaaggcgcgccgcctgtcgctgtcgcgggcgctggaagtgcgcaaatacctgatggagatgggcgtccgctccacccgcatcgaggtgcgtgccctgggcaacaaggtggagagcggctcgcccgatcgcgtcgacgccatgctggtggcgcgctgaggcggcggccgcccgccctaattcggacatgatcgcgcgccaggatgcatggtgcgcgcgccccgccgcccgcagccagatcgagtgccgtccatgatccgtcccacccgctatctgttgcgcatggccgccttcctgctgctggtcgccgccctggcggcgatgctgcacgatgggttggtggcggccttctcccacaatccggcgctgaacggcctgttgctgggggtgttcctggccggcatcgtgctcaacttccgccaggtgatgctgctgacccccgaggtggagtggctggacaactggcgcaagggccagccgaccctgtccgggcgcctgcgcctgctggcccccatggcgggcatgctgggcgagcggcaggggcgggtcagcctgtcggccatggcgctgcgctcggtactggattccatcgccgcccgtctggaggaacagcgcgacctgtcgcgctatgtggtcgggctgatgatcttcctcggcctgctcggcaccttctggggcctgtcccagacggtgggctcggtgggcgagatcatcgcctcgctggccctgggcggggccgacccggcggtggcgttcgaggccctcaaggccggcatggccaagccgctggccggcatgggcaccgccttttccacctcgctgttcggactggccgggtcgctggccctgggctttctcgacctcaatgccgggcaggcgcagaacgccttctacaacgagctggaggaatggctggccggtcagacccggctgggcaccggcgggccgctgggctcggccgaggagggcggcgccgggcaatcggtgccggcctatatccaggccctgctggagcagaccgccgacagcctggacaatctccagcgggtgatcgcccgcggcgaggacaaccgcggcagcgtcaacgcctcgctgacccagctgaccgaaaagctgtcgacgctgaccgatcacatgaaggtcgagcaatcgctgctgctgaagctgggcgagggccagttggagacccgcgccctgatggcccgcatggtcgagggcggcaccggcggcggcatggatgacgccagccgcaatcacctgcgcagcctggacggcagcatgaagcgtctggtggacgaaaccgtggccagccgggaccagctgacggcagaactgcgctcggaaatccggctgctggcgcgcaccatcgccgccatcgccgaggaaccgctggagcgctgatccatgccgctcggccgccgcgcccgccgttccgtcgatatctggcccggcttcgtcgacgccctggcgacgctgatcatggtcgtggtcttcctgctgatgatcttcgtgctggcccagttctttctgggccaggcgctgtcgggccgccagaaggcgctggacgatctgggccgcgagatggccgccctggccgagaagctcaacctgcagaccaaggccaacgccgccttgcaggccgaactggtcagcagccgcgccgagaaggaaaagctggagcactgggcggcgggcgtgcagcaggacatggcggcgctgctgaccctcaaggacgagaaagaggcggagctggccgccgagaagaagatttccgacgagggccgcgcccaactggccctgctgagccgccagatcgaggcgctgaaggaggaactggcccgcgtggctgcggcgctcgacgcctcggagacccgcgacaaggaacagaaggcccagatctccgatctcggcaagcgtctcaacgtggcgctggccggcaaggtcgaggaattgcagaagtaccgttcggaattctttgggcggctgcgcaaggtcctgggcgatcgtcccggcatccgcatcgagggtgaccgcttcgtcttccagtcggaattgctgttcgccaccggctcggccgagctggggaccgagggcgccgagcaggtgcgcaagctggccgccacaatccgcgagatcaacgcgggcatgcccaagggcctgaattgggtgctgcgggtggatggccataccgacaagcggcccatcacctcgggcaagtttccctccaactgggaattgtccaccgcccgggccatcaccgtgctgcgggcgctggccgccgacggcgtgcccagggaccgcttggcggcggccgggttcggcgagttccaaccggtggacagcggcaacaccgaggccgcctatgccaagaaccgccggatcgagatccgattcgatcagcggtagggccgggacgacccgccccttttcccctcacctccgggacggcccggccttgacggagcatggtcacatgccgtggatctatctgttgtcggccggcttgctggaaatcggctgggccgtggggctgaaatacgtggacggcctgtcgcggccgcttcccctggtgctgaccggggccgccatggtgggcagcgtggtgctgctgggcatggcggtgcggaccctgccgctgggcaccgcctatgcggtgtggaccggcatcgggacggtgggcacggtgatcgccgggatgatcctgttcgccgagcccgccgacgccctgcgcctgttctgcatggccatgatcgtggccggcattctcggcctcaagctggcgtgattataccgccggcctctttgctcccacgtctcatgtcatcccgagcgaagccgagggatctccgcctggaccggcggcgcccgttctgaaaagccgtgccaggacgagatccctccgcccaggggcgtcgggatgacaggtcggtatcagtcctcctccaccgtgaaggcgtccaggatgtcctcgaagccgccgtcgatgttgtcgggcgcgatctgggcgaacaggtcgaggatgatcaccgcgttgagcagcgcatcgcggctgaccgagttgcgcatgcgctcggccaggtgcgagttcatcaccgacaggtcctgatagtgctgcttcagcccatccagggtcaccggaccttcggtgccggccatgcgctgctgcacgatggacgacagcagccaggacgagaacgagcggaacagggtctcctgctcgtcggcgaagggcaggtggaagcgggccatgggccttaagaaacgggtcagcgggcagcccgaggtggcgcagaccaggccgatcagcgagcccagccccgcttgcagggtggtcttggccacgatggtgcggttgtcggtgtcgacctcgaccacggccttgtcgtgggagacgcaatccttgaagctgggcaggaacatggcgatgcccagggccgccgggcaataggcgcaatcgtcggacaaggtgcagttggggcaacgcttgtggctcagcttcgtccagtccggcttgggcgccgtggaggggatgttgaggcggaaggtcttgcggtcgaaatggagatcgacctccaagggcgcctgcgccccggtgaagaagcggtaggtgatcttcttcaggtcgactttcgatgtctgatccatcgtgcaatccaagggggccatggtggtctccagtcgcatatgaatccgtggtgcgatgcttggattctaagatggatatcgcccgctcaacaatcaggcggcccccttaatcccttcggcgcaggcttggtgcgaaggtatctttttggtctccgtcaaaaggcgtagtggcgggaaagtacctaggccaatgccttggaatacaagacacatctccgcgccctaatttaatggggtgcaatgtgaatgacttgtaactgctttgattaaattagaaaattctagccgattgatgttggcccattgaaaatggtgccgatcagcagcaccacacccagcacggtgatggacagcgagccggccagggcgaggccaagacgcatgcgccctcccaggctcgacccgcccaatccccgctcgaccagccggttgagacccagcgcccccaggccgatggctgccaccgtcgccgccacgcccaggcccatggccagggtggcaagcacgccgatcaggatcatgccgttggcgaagcagaacagcaggaccaggatggcgccggaacaggggcgaaatcccaccgccgccgccatggtgaacagggcattgcgttcggccgtctcgtcggggtgatgaggatggtggccgccgcagcaggccccgtgatggtggtgatgttcgtgcgggccgtgatcatggccgcagcctctgccggtcagggtccgccaggtcatcagcccgccgatgacggcgatcatggcgaaggagcccagctccagccaggcggtgccggcggtgatggcgcggggcgccaggctgagcaatccggccagcacgcccacggcgatgatggccgaaccggcctggaccatggcggcgatcaggctggcggtcaggccgtggacgatgcgggcgcggcgggtggcgaaccagccgccgatcaccaccttgccgtggccggggccgaccgcgtggaacacgccgtaaaggaaggcggcgaggatgatggcggcggcgggctcccacgagccggtgttcttcatcaccgccagttgctcgcgcagctcgccggtgagctggcgctgcagggcgaagccccagctggcgatactgcgcaggggttccggcaggtcgccacccggcgcgggcgtgccgccgccccccggaaccagggcggcccaggccgacgcgggcagcaggcccagcagggcgatgctcagccacatgggtcctactcgcatgaaatcgtcgcccgcttgggcgtcaccgctccgccgaagatggtattgccgagatccggggcgatggtcgccttgcagccggccgagccttcgccagtaagggtaacggcgttgtcgctggggaagtccatgtcgatgtagaaggtctcttcataggtggtgaagctgaacgcctcccggcgcgggtccaccggccggggcaggggcaggcggaaagcgtacatcagcgagtccttgacggcgaccaccttgaagtcggtggcgtccttccaaacgaccgggtccgcccctaggcgggcgtaggtgaaatgagcctggggcttggtgtcgcgaaaggcttcgcgctccaggtccttcatttcgtcgggatcgaggcggttgtttttgttcttgtcgaaatccttgagcagcgaggcgctgaacaccgggtcgaacttccagcccatgaacaggctgacgatcttgccgtccttgaactccgccagggcgtggacatccaccaggacgtggggatgagccagggccgggagcggaattgtgagcgtcgtcgccaatatcgcggcggcgaaccgtccgcgccacctgtcatcccgacgaccagcgggaggagggatctcgttccgcccgggcatttccgccctggcaccgccgtgccgggcggagatccctcgcaggcgctcgggatgacacgccgttcgggtcaggaaacggcgcatgccagccgctcgaagccgcgttccaggtcttcctccaggtcgtcggcgtcttccagtccggcgtggaagcgcaagcttggcccgacgggcgtccagggcgtggcggtgcggatgatggaatggcccgaggtgggaatcaccaggctttcgaagccgccccacgagaagcccagcttgaaatgggaatagccgtccagcatggcatccaccgccgccttggaggcgggcttgaggatcacgccgaacaggccgcagccgccggtgaagtcccgcttccacagctcatgccccggatccgaggccaggggcggatacagcacgcggtccacctcgggccgggcctccagccatcgggtcaggcgcagggcgctctcggcgtgctggcgcagccgcacgggtagggtgcgcaggccccgcaggccgagatacatctcctcggtccccggcgaggcgccgaaggccgccagcgaggtcttgacctgcagccacagctcgggcgtggcggcggtgatggtgcccagcatggcgtcggcatggccgacgatatacttggtcgccgcctggatggagatatcgatgcccttggtgaagggctggaagtgcagcacgccccaggtgttgtccatcatgaccacggccccgccggcatgggccgcctcggcgatggcgggaatgtcctgcacctcgaaggtcagcgagccggggctctcggtgaacaccacccgggtattgggccgcatcagggccgtgattccggcgccgaccagcgggtcgtaataggtggtctcgatgccgaggccgcccagcaccgaatcgcagaacttccgcgtggggaaataggtcgtgtcgaccatcagcaggtggtcgcccgccttgaggaaggccagcagcgcgccggtgatggcggccagacccgacgaagtggcgacggtacggtgcccgccttccagctcggccaccgcctcctccagggcgaaggtggtgggcgtgccgaagcggccatagcgcacgccttcgaacggggtcttgccgctcttctccatggccgccaccgaggggtggaggatggtcgaggcatggtagaccggcggattgaccgcaccgtggaaggcctccggcttgcggccggcgtggaggatgcgagtggatttcttcatggtgccccggcaatggctttcagggcgggcatggtgccccgccgaagccgttcaagccaaggactttcgcgactcagcctgccaggaacgcggcgatggcggccagcgccacaagggcggtcgcggcggcgaggatgaagccggagttgtcccgagtggcaacgcgggcacgggcctgacggttacgcatggggcatctccttttccatcctgaccataaatatggacccgaaccggcccctcttcaatacgagatccgtagccagcgctccgcaggggagaaaaacctatcctacggtataggcgggttgatgggggcgtctcatggcctaagtgatataatgttggggccaattcgccttggaggctcgatatgactcggatcggaattctgtcggcggctatcgttgccgccggcttggtggtgtccagagttgcgcccgcaacggccggtgatgccaagcaacagatcgccacggccgccgcccacgccggaatggctgccgcgtcgccggaagataaaatggtcaggggacaccttcagcacgtggtcaattgcctggtggggccggcgggagaggggtatgactccgcccaggccaatccctgcaaggaccaggggtttggtgcccttcaggattcccccatggataaattgcccgccttgcaggcggcgctgaagatggcccgtgatggaatggccgaaccggattcggccaaggcgcgggaaaaggcggtggccactcaaagtgctctaagaggccgtccggaaggttcttgaatcaggtgaatcggttatgattccatgggtctccagagaaatgctgggggcgccatgtggaccaaggacaaccgacggctctatgagcggagcggacttcgctatccaagtgatctgacggatgaggaatggtcgctggtggcgccgctgatcccaccggcaaagcgcggcgggcgccagcgaacggtggatcttcgtgaagtggtgaatgggatcttctacgtgttgatgaccggttgccagtggcgagcattgcccacggacctgccgcccaaaagcacggtgcatgaatatcttgggctgtgggaatgggatggcacgctggcacgcctccatcacgccctgttcatcgaggtgcgggaactctccggcaaagaagccagcccgacggcggcgatcatagacagccagagcgtcaagggcgcggaaaaaggggggcgcggattgatccatcgggctacgacgctgggaagaaggtcaaaggcaagaagcggcacatcgtcgtcgatacgcttggcttgatcctcgcggctcatgtccaaccggccgatgtccaggatcgtgatggcggattgccggtcctcaaggaggtccggcgcctcttccccttcatcgttcgggtgttcgctgatggcggctaccagggggccgccaccgcggcagccgtccgcgcactcggggcgtggcacctggaaatcgtcaaacgctccgacaccgccaaggggttcgaagttctgccaaagcggtggatcgttgagcgcaccttcgggtggctggggcgttgtcgccgtctcgccaaggacttcgagaatctcgccaggatggcgctggcgtttcttcgcctcgccatgatccgcctcatgctgcgaaggatagcaagacaccggaaatcataggaaacttcacggacggactctaagtaaattatcaatgtaggtctgtaaaaacagtgtagtaaaaattgacattctgattgttacttgcggcgacaatgctactgcaggcagatgtcgccgcatatcacccaggggttattcagttttttgaatgtgttaatccacggttgcgttggcatctccgtgggcggcttggcgaaatcctaggccaatccagcttgccaacggtcatggcctgcttaaggcatagcctggtggcgaaatgcttgccgtatggattggttactgtccatgtaaatatactgaacttctcaagatgaattgatactctgcggccaatcaaaaaaggcgcgatccagggggcgtcggggtgattggcgatttgcgtatcggatttcggctatctttcaccgtcgtcattctgctggcggcgctggcgggggtgtcggcctatgccctgcacgagatcagggaccgcctgctgaccgagcggcaaagccagagccgcgtcatggtccggggcgctatttcccagatcgcccgcttcgaggacttggagcggaacggctccctgggtcgggagcaggctcagtcggaggcgatccgggccgtcaacagcctgtatttcggccccgatttgtatgtctggatcaatgattcccgcccggtggtgctcgcccatcccgtccaggccatcatcgggcgcgatgtgggggacatccgggatgcggacggtcgccctctgttccgcgaatttctccggctcagcgcggccagcggtcacgggacggtgacctatcgctggccacgggtgaatgacgatgtgccgcggttgaagatctcctatgtggagggcttcgccccctgggattggaccgtgggggcgggcgcctatgtggacgacatcgatgccgcctatgacgaggcggcccgccggttcgggctgttcgccctgctggccggactggccgccgccctggtggcgtggctggtgggggtgggcatcacacggccgttgaaacaggtcacccggtgcatgacccgcctggcggcgggcgagtccgtggaggttccccagcccgcgcgcggcgatgaaatgggcgatctgatgcgggccctgggcgacttcaagcgccacctgtcggaaaaggagcagttccgcgaggcccacgattccgtgttgcgcgaggccgggaccgtcttcaatctgatttccgacgcggtgatggtgaccgaccggcgcaaccacatcaagctggtcaacccggccttcaccaggatcaccgggttcgcgccggacgaggtcatcgggcgttccccctcgatcctctcctcggggcgccacgacaaggcgttctatgccgccatgtgggagcaattgtcgtcgggcggcagttggagcggcgaggtctggaaccgcgccaaaagcggcgaagtctttccggaatggctgtccatcgtcgccattcgggaccgggcgggcgaggcccatggctatgtggccaccttcagcaacatcgccgagcggaagcgccgcgagacccgtatgcgctggcaggccgagcacgatgcgctgaccgggctcgccaaccgcgtccatttcgagaccgccctggcggtggccctgtcccaggcgcggcagaccggctcggagcttgccgtcctgttcatttccctggaaggcttcaaggaggtcgccgacaccctggggcgtgccatcggcgaccccgttctctcggtgatggccaagcgtttgcggcagatcgtgcgggccgacgacgtggtggcccgcttgggtggggatgaattcgcggtgatcatcccgatgctgcagcacgaaggcaatgcccgctttgtcgccgggaagattgtttcctgcctcgccgagcctgttattctcggcaatactcaggcccagatcagcgccaacgtgggggtggccatccatccccaccatggaacctcgcccaaggaactgctgtccgcggccgaccatgccatacggtgcagcaagcaggcgggccgcagcggcattgccatggccgaggccgcgccatcctcggccattcgggcgtcttgaacgaaaaacccccgccggcgagggcgggggctgatccatcctggtccgggcttggccgtggacctacttctcgatgggcgtgtcgtcgcggttgccccattcggcccaggagccgtcatagaccgccacgttctcgtgccccaccagatgcagcgccagggccacggtgcaggcggtgacgcccgagccgcaggagatggtcaccggctgcttggaatcgatgccggcggcgtcgaagcgggccttcaactgctcggtgggcagcatgcagcgggtgcgctcgtcgatcaggtcggcgaagggcacgttgaccgagccggggatatggccctgatgcttggtggggcgaggctcggcggcctcgcccttgaagcgggcgggggcgcgggcgtcgatcaccaactcgcgcttgctctccagattggccttcatgtggtccaggtcgcggaccagcagatggttgtagtggctgatgaagtgccgggtgcgcggcaccggcggcaggtcttccaccggcaggccttcgcgcagccacttggggaagccgccgtccagcaccgacacgtcgcggtggccgaaggtgcggaacatccaccaggcccgcgccgcggcgctggcaaagcccgagccgtcgtagatcacgatcttgttgccgttgcccaggcccagcttgcgcaccttgctggagaacttctccggcgcgggcagcatatggggcagggtggaatcggtgtcggcgatctcgtcgatgtcgaagaacacggcaccggggatatgctcggcgtcatattcctcgcgggcgttgcggttctggccgggcgtgtaccagctggcgtcgaccacgcgcacgtcgggcgcgctgaggtgcgaggccagccactcggtgctgacgagggcgtccgaattgggatgcatcatgcttcaattccccccttgcgggtttgcttttgtttggtcgccgctcactccagccaatggggcaccggcagattgcgttcccgcaggaaggccggattgaacagcttgctttgatagcgggtaccataatcgcagagcactgtcaccactgtgtgtccgggtcctaatatgcgcgccaccttgatggcggccatcacattgattccgctcgatcctcccagaaccagtccctcctgccgaaccagatcgaaaatcagcggcagcgcctcgtgatcggtcacctggacctgatcgtcgatgggggcgccgtccagattgcgggtgatgcggccctggccgatgccttcggtgatggaggtgccctcggccttcagctcgccatgggcatagtggtggtacagcgccgagcccatggggtcggccagcaccaccttgatgtccttgttgtgctccttcagcgccatgccggtgcccgccagggtgccgccggtccccaccgcgcaggtgaaggcatccaccgtgccgtcggtctggcgccagatctcctggccggtggtgttgaagtggcccatgcggttggcggtgttgtcgaactggttggcccacagcacgccattgggctcggtcttggccagttcgttggccagggtctcggaatagcgcacgtaattgccgggattggcgtagggcacggccggaaccagacgcaggtcggcgcccaccagccgcagcatgtccttcttttcctggctttgggtctcgggcatgacgatgaccgtcctgtagcccagggcattggccaccagggccaggccgatgccggtattgcccgctgtgccctcgacgatcacgccgccgggcttcagcaggcccttgcgttccgcgtcctggatgatggccagggcggcgcggtccttgaccgatccgccgggattgaggaactcggccttgcccaggatgttgcaaccggtctcctccgacgcccgcttcaggcggatgagcggggtgttgccgatggaatcgaggaagccgtcgcgaatgtccgtcatggtttgtgtagtttccgtctaattgccattgcaataatgtagctagtcggatcgtgggctacaaggcctgtaaaactcccttcacccgctcgggcgtgaacggcacggtgcgcagccttgcccccaccgcgtcgaacaccgcgttggccagggcggcgggcaccggggcgcaggccgcttcgccgccacccatgggcggttggtcgggccggtccagcagctcgatggcgatgtcggggaccgcgccgaaaccgaggatggggtaggtggactggtcggtggaggtgacgcgcgaggcgtcgaaggccacctcttccagcagggtgcgcgacagggtctggaggatgcagccctcgatctgcatcttcagcgcgtcgggattgatcaccagcccgcaatcatgggcgcaggtcaccttcttgatggcgatgcgcccggtgtcgcggtcgaccatgacctccatggccatgcccacataggtttccgagtgcttgtagtgaacataggcgatgccgcgcccggtgccgtcgccggcggggttgggcgaggggcgcggcgcccaggccatcatggacgcggccttggtcagcacggcgacgccccgcagatcccggaggccgatcaggcgggtgaccagggggtccagccccacgccagcgcacagctcatcgaaatagccttccaccgcgaaggtgttggcgatcttgcccggcgcgcggatgttgctggggcgcaagggggcttcggcctgccagtggaccttgacctccagatcggcgacggcatagggcggatcgccgttctgggagatcaggccggtgatcaggccctggggctgggcgatgcccgccgcctcgggggccagcaacggcacgttgaccagtccggcggtggccttggggagccacatctcggtgctccagccggccagcaggccggagggcgccatggcgccgcgaatggccagcaattgcggcggacccttggggtcccaggccagctcgtcatcccggctccaggcgacccggaccggcttgcccgtggccttggccagcagggcggcgtcggcgctggcgtcgtcatggccgttcatgccgtagcagcccgagccgtccagatagaccatgcgcaccttgtccacgcccaggcccagcagggcggccaaggcggggcggaacttgtgggtggcctgcgacgcggtccagatggtggcggcgccgtctttgacctgggccaccgcgcagctcggccccagcgagccgtgggactgcaccggccagtaatactcggcggcgggcggcgcgtcggccagggcggcggcggcgtcgcccttggccttcaacacctcctcggcggcgaagggcggggtcttcagccagtcgcgcaccgcctgatgacccatcagcggggcggaatccgaccattgcgccttcagcatcccggcggcgcggacggcgtcccattcgcggggggccaccacggccaggaagtccttgaggcgcaccacgcgggcgccgcggatggccttgatggaggcctcgtccacccggagcaggctggcgcccaccgagggcgggcggatgacgcggccatgcagcatgccgggcagcttgaagtcgtggacataaacatgggtgccgcagaccttggccggcaggtcggggcggggcaggggcttgcccaccacgcgatagtcggcgggattgcgcagcggcgccttggggtccaacttcagggcgaagccgccctcgcccaccagatcgcccatggcgatggagcggccagattcccgggggcccaccacgccgtcgcggagatccagttcctcggcgggtaggtccagccttgcggcggcgaggcggatcagggcctgacgcgccgtggcggccgcctggcggatctgcacgccgcccttggccacgccggtggagccggcggtgggtccctggtcgggggtcagcgccgtgtcgccctcgaccagggcgatggagtcaatgccgatacccagttcctcggcggccatctggcggatggcgacgcgcaggccctggccgagatcgaccttgccgcaatagacggtgaccttgccgtcggcgccgatggccaagaacccgtccacctcggcgggatcgttggtcttggccaaggcggcggcggctccagaggggcggggcagggcgaaggccacggtcagggccgccatggagcccagcagggcgcgccgggacagatcgaggctcatgacttgtccctcccgccggcgcgcatcacggccttgagaactctttggtggctgccgcagcggcagagatggccgtccagcgcctccttgacctccgccagatccggctgggccgtgcgggccagcagggcggcgccctccaccaccattcccggtgtgcagaaaccgcattgggccgcctgctcttccacgaaggcggcctggaccggatggggagcctcgggggtgcccaggccctcgatggtggtcaccaccttgcccgccgcctcgcccagggtggtccggcacgaccgggcgggctggccgtcgatcagcaccgtgcaggcgccgcattcccccttgccgcatcccagatgggtcccggtcaggcccagttcctcgcgcagccagtagaccagcggcatgtcgccgtcggccagcgcggcgcggcgttccgtgccgttgacggtgagggagagttgggcgggggatttcgccttcgcggcggtcgcgggttttccggccatagggtcctcgcgtgtcatgggtcgggtagtatatgggcaaacccgccgcttgcccaagaccgccttgatccgctacaccctgatcgcccggacggcgggcgcaatcggcccggaggtctgctggtgaagacgcgtcccgtactcctgatcctgccggccctgttcaccgccctgctgttcgccatgggtgccgcctcccagccgttctggcaggtgttcaatctggaccccgattactattacctgaccaacggcctgatgctggtggaaggtctggcccccaccgacatgggccatcccggcacgccggtgcatgtgttcttcgccatcgtctaccggctgatgcatgtgggcgagcccaccggcgccatcgtcgacgcggtgctgaggaaccccgaacaccatctgagggtggtgacctgggtgatgtatccgctgatcggcctgtcgctggtggccctgggccgcgccattttgacggcgaccggacggttggccccggcgctgctggcccagggcgcgccgttcctctccatgattatccccaaattcggcctgcatcccaagccggagggattcctgatcatcgccgtggcctgggtgctggtcatggcgctgcgggtggcccgggccgagaccctgaccgaccgtcaggtgggctggctggggctggcgctgggcttcggcatcgcctgcaagatccagtttgtggcgctggggctgatcccgctgttcatcctggaccgtcgccggctgttcctggtgctgcccctgaccacggcggccggtttcctgttctttttctcgcccgccctgccgtcgctggacatcttcctgggctggtggagcaaggtgctgacccacagcggcgcctacggcaccggcgaggccggaatggttcaggcggggcgctatccccgggcggtgatcggcctgttcggctccaagatcgtcttcaccgtggtgatcgtcctgtcgctgttcgccctggccggctatgtgcggctgcgccgccgcggcctgattccggcggaccgcctggccgggctgctggccggcatggtggccgcccaggtgttcaccatcctggcggtggccaagcagcccgccgcccattacctggtgccggccctgctgctgaccggacccagcctggccatcctgttcgtgctgtcgggcaaggtgttctcgccccggccccatttgcgggcctgggcgggaatcgggctggtgctggtggtgctcagcgcccatgcctcgtggaagcagtatgccgagctggcccgctggaccgccgaaacccaggccttcgacatgagccgctttgcggcctgcgccaagatcgactacgattcggcgtccagcctgccctacgcgttgcagcgcggcgacatgaactccaaggcgcgctattcccccaagctggccgagttcatgccgaaggaccactacacctggttcatcaacgagcatgcctggtggagcagcggcttcatgcagtggaacaagcccatgaagctggccgaggtgctggccgcctatccctgctcgatcttccgcggcaatcaggggtcgcgcatgatcgagtgggcaacgcgcgagctgggctcgttcaggcccgacgacggctgtccggtgggcgaggaaaacgtcttcacctttggaatccgctgcgacggctcaacccctcttgcaaaatgaggccaaagggatagccttctggtcagcaatctgacgagggggacatcatggcggccaaggccgtaaccatcgcccagcaaaagggcggcgccggaaagaccaccatcgccgcgcaactggccgtggcctttgcccgtggtggcttgcgcgtcggtctgctggacatcgatccgcagggctcgctggccgcctggtacgacatccgcaaggccctggtcgaggaagagggcggcggtatcaccttcgtgcaggcctcgggctggcggctgtccaccgagctggaccgcctcaagcgcgacgtcgacgtggtgctgatcgattcgcccccccatgccgaaaccgaagtgcgcatcgcggtgcgcgccgccgacctgatcctggttcccatgcagccctcgcccatggatctgtgggccaccggccccaccctggacatggcgcgcaaggaaaagtcccccgccttgatggtgttcaaccgcacgccgtcgcggggcaagctggtggacgccgtgcgcaagaagatcaaggacgccgaggtcccggtggcccagaccgtgctgggcaaccgggtggccttcgccgcctccatgatggagggcaagggcgtggtggaaagcaatccccgccacaccgccaccaaggaaatcaaggcgctggccgtggaaatcgccggcatcctgggactggattgagatcatggaaatgctctttgatcacgcctatgccattgccatggccctgcacaccctggcggcggtggtctgggtcggcggcatgttcttcgcccatctgatcctgcgccccgtcatggccgagcgcccggcgcccgagcgtctggcggtgtggcgcgaagtatttccccgcttcttcttctgggtgtggatcagcatcctggtgctgctggtcaccggctattccaccttgctgctgggcttcaaggccggcttcaccgggggacccagccatgtggacatcatgcagctcatcgggctggtgatgatggcgctgtacttccagctgttcttcggcccgtggcagggcttcaagcgggctttcgccgcgggggactttcccaaggcggcggagtatcaggtccgcatccggcacatcgtcacggtcaacctgatcctgggcatgatcagcatcgtcgtcggcgtggccggctcgctgctgggggcgtgacggagatggaccgggacgccatggaccgggaccgggacgtcgagatcctttccaaggagacggtgttcaagggctatttccaggtggaccgctatcgcctgcgccatcgcaccttcgccggtggctggagcgaggagatggtgcgcgaggtgttcgagcgcggccatgcggtggtggtgctgctttatgatcccgaccgcgacaaggtcgccctgatcgagcagttccgccccggcgcctatgccgccggctggcatccctggctggtggaatgcgtggccgggatcatcgaggagggcgagcaccccgacgaggtggcgcggcgcgaaacccgcgaggaggcgggatcggaccccaccgacatgattcatatcggcgactatctggtcaccgccggcggctcgtcggaaagctgcaagctgtattgcgcccgggtggattcctcgatcatcgccggaacccacggccttgcccacgagggcgaggatatccgggtcttcgtcatcgatccggccgaagccctggccatgtgccgcgatggccgcatcaacaacgccatggcggtgctggccatccagtggctgatcatggaaagggacggcctcagggccaggtggctgggcgcctgaagcgttacccctgggcgttgccggccaggaccagcagcggctgggcgccgtcccagatcatgcgcagcgccaccaccacgatgatccccaggcccacataggcgatccagtgccagcgcttgaggatgcgcgccaccgtctcggccgccgcgccggtcaaggccaccgacagcgccagccccgccaccatgatccagacgtgctcgcgcgccgctccggccactgccagcacgttgtccagcgacatggagacgtcggccagcacgatctgcttcaccgcctcggagaatttcttgggctgggccggcggcgcgtcggaatccgcggcgtcgtcgctcccatgggccgcctcgcgcagttcgcgccacagcttccatgacacccacagcagcagcagcccgccggcgaacagcaggccgatgatgcccagcagttgcacggcgaagagtgagaacaggatgcgcagtcccgccgccgccgcgatgccccaaagaatggccttgcgccgctgctcggccgccaatccggcggcggcgatgccgatcaccacggcattgtcgccggccagggtgatgtcgatggccacgaccgaggccagcgcggtcagttcggcggcaagactcatgaaactcccccaaacagcaggcggcagacgatgattgcggcgatcagggcggccagatcggccagcagtcccaccgccagggcatggcggatgcgccgcacctgcaccgccccgaaatagacggccaggacgtagaaggtggtttccgtcgaaccgtaaagggtcgacagcagggcgcccagataagaatccgggccgatggccgggtccttcaggctggacgccagcatgccgtaggagcccgagccggacagggtgcgcatcgccgccatcatcagcgcctcggccggcaggcccagcccctcggtcagccgtcccagggggcggatcagcagatccatggcccccgaggcccgcaccatgccgatggccgccaggatggccaccagataggggatgatgcgcaccgccacgtcgaagccctctttggcgccttcgacgaagctctcatagagacgcacgccccggcgggcgccgaacagtagcagccccacgaccagaccgggcagaatccacggccccagaaccttgccccaggccagcagcgccgccgcgccggccagtagcccggccagggcgaggaggcagggccacagcgaagcgggagcgggctgatcgggaaccgtctcgatcatccggggctgccacaggccttgcagtccccgcgcggccagcactcccaccagggcggcgaccaggctggcgatcagggtcgaggcgacgatggcggcgggctgggccgatccggtggcggcgcgcagcgcgatgaccttggtgggcagcagggtcagcccggcggtattgatggccaggaacagcacctgggcattgctggcggtgcccttgtcgcggttgaggctttccagatgctccatggcgcggatgccgaacggcgtggcggcattgcccagccccagcaggttggcggcgacgttcatcaccatggcgcccatggccggatgcccggcgggaatctcgggaaacaggcggcgcagcgccggttccagcaggcgggccaggatgtcgagcaggccgccggcctcggccaccttcatcaggccgaggaacagcgccatgatccccaccagtcccaaggccaggggcacggcgcccgccaccgaatccaccagaccggccgacagcgcctccatggcgcccgctccgcccgacagttcggcgaaggcggccaccaggaacgagaccagcaccaggaccaggaatacggcgttcaacgggcagttccccccacttcagggaaaacctagcagaaggaacggcgtcgcgcatccttgccgcctgcccttggccgttgtaaagcttttggcgaaacatacgggagagagtcaccatcatgcgccgtgccgcgcttatcctcggcctcgccgccctttgggtctgccccgtgatggctgccgacaccgtccccgcccgcctcgatgccgcccgcgccgcccatgccaagggggatctggcccgcgccgccaccgagctggaggccgcattggtcgagctgcaagggcgcctgggcaagatgctgggcgagttcctgccgcctcctcccgccggctggcaggccgagccggtggaaatccagtccctgtcgggaagcggcggcggtctggcggtgacgcgggcctatgcccgtgacgacaacacgctgaacgtctcgctgatcatcgacagcccggcggtgggctcggccgtcgcccagttggcggcctttccccagcccaacgcccgcaaggtgaaggtgggcggcgaggacgcggtgctgcgctgggatgcccagggccgcaacggcgaggtgctgatggtgctgggcccccgcgtcctgctgcagatcgagggcgacaacctcgccaccagcgaggtgctgagcgacgtcgccaagggctggaacctgggcggcatccgcaaggccctaccgcagtaaccccaccagcagcggcaccagcacggcggtgatcaggccggtcagcccgatggccagcccgccgaaggcgcccgccgtctcgctcatctgcaaggcgcgcaccgtgccgatgccgtgcgacgcgatgcccagcgccagaccgcgtgccgcctgatccttgacccggaacaggtcgaggatccagccgccgcacaccgcgccgaaaatgccggtcagcatgaccatcacggcggtcagcgagggaatgcccccgatgcgctcggtaatgcccatggcgatgggaatggtcaccgatttggaggccagggacagcagcaccttctccgacccgcccagcgcccaggccaccgccacggcgctgactccggccatcaccgcccccaccaggatcaccagcaggatggcgggccaggcacggcgcaggatgggcatctgggcgtaaaggggcaccgccagggcgacggtggccggacccagcaggaagtggacgaactgcgccccgtcgaaataggtgcggtattcggtgcccgtggccatcaggaagccgacgatgatcaccaccgagaccaggatggggttgagcaggggcgagcgcccgcccttctcgaacagccacatggccgcctgataggcgatcagcgtcgaggtcagccccagcagcggcgaggtggaaagatagatccagatgctggacaggtcggtgctcatcacttggcctccggcttatggcgccggctcagggcctgcatgaggcgtcccgccaccacgatggtggcaaaggtgctgcccagcaccgccgccgcgatgggcagcgcctcctcggcgatcagcttcaggtgaaccatcacgccgacgctggccgggatgaacagtagggcgaaattggacaggatggccttgaccgccagatccaggccggcgggaacccgaccccggaccaccaggccggtgaacagcagcaccatgcccaccaccgggccgggcagcggcaggccgatcagccgcaccatcacctcgccggcaagctggcacagcagcagaaccgtgatatagggaagcacgatcggtttcctttcaggtgcggcaccatggactggctttcacccatcgacctgctaggcgcggcggcgggcgtccttacgaccatctccttcgtgccccaggtggtcaagaccctacgcacccgacagaccagggacatatccctggccatgtgggtctgcttcatcaccggggtatccctgtggacggtctacggcctgctgctgggagcctggcccatcgtggcgtccaacctgcccaccctggggctggccggcaccatcttggtgatcaagcttcggaacatgggaaaggaaacgggaggcgattgaaaccgtgcgcagccccccaggcgggcgcggcgcgcccttgccttccgcggcataggccgcgcggccatcgagtatatcctgattccccggagggaggggcctaaccctgccgccataggcggcaggggacgtttccacctcaggcgctgcggccaccgtgcaggctggaccagcccacgggatcgtggaggaaggagcggacggcctcgacggcgcgcttgtcgaactggccttcttcctcgaccacttccagcacatcccaccaattgcacagatagcccaggtcgacgccgatctcttccaggctcttcatggcgccggggaagacgccgtagaagaacaccacgaaggaatggtcgaccttggcgccggcttcgcgcagcgcgttgacgaagttgaccttggaggcgccgtccgacgccaggtcctcgaccagcaccacccggtcgccgtccttgaagtcgccttcgatctgggcgttgcggccaaagcccttgggcttcttgcggatgtagagcatgggcaggcccatgcggtcggaaatccacgcggcataggggatgcccgccgtctcgccgccggccaccgcctcggcggattcatagccgacctcgcgcatgatggccttggtcatcaattcgcagatcttggtgcgggcgcgcgggaacgagatcaccttgcggcaatccacgtaaaccgggctggcccagcccgaggtcaggatgtagggctcttccgggcggaaattgatcgccttgatttccagcaggatgcgcgcggtggtcagcgccgcctgcttctgttccggggtgcgggaaacggtggttgccatgtggggagccctcttgccttgccgataagggggtctataggcacaatcgcgctttcctgcaagaagacagaatagggaactgaaatgtccgacgtgatccagctggtccgagagggcgccatcgccaccgtgacgctgaaccgccccgaccgcatgaacgccctgaacctgcccatgtggcgcggtttggccgaggcgttcgagaccatttcggccgaccggtccattcacgtggtgatcttgcggggtgccggcaccaaggccttcgcgccgggtgccgacatcgaggagttcgacaccctgcgggccaatgccgagcaggccaaggcctatgatctggtcatgcgcaaggcgctggacacggtgcgcgcctgcccgcagccggtgatcgccgccatctgggggccttgcgtcggcggcggcctggaactggcctgttgctgtgacatccggctgtcggccaagtcgggcaagttcggcgtgcccatcaacaagatctcggtggtgatggcctatcccgaactggctcagatccgccgggtggccggtccggccgcggcgctggagattctgctggaaggccggatcatggatgccgacgaggccgccgccaagcggctggtcaaccgggtggtcgaggacgacgccatggacgcggaagtggccgccaccgccaagcgcatcgccgccggggcacccctggccaatcgctggcacaaggccttcatcgcccgcctggacgatcccaccccggtgtccgaggcggagctggacgagtgctaccgcttcctcgacaccaaggattacgccgagggtctggcggccttccgcgccaagcgcaagccggtgttcacggcggaatagggtgatccccgacccccctttgtttttatcaataaaatagaagggggtccggggctcgccccggatgggtccgggcgatagcccgcccggggtacggcgcctacccccgcaaagccgcttccatcatctgaggcatgaggcggaggtcggtgtgggggccgacctcgcgcttgtccaggcgctgggcgatggcggccaccacggcgggcttgccgggaacgccgaactgggtgcggaagccggcgcggcccagcagcttgtaggcggtgaccatggccaccgccgcctggaaggtgctgaggcccaggcgggcgaacaggtcggcgtgcaccaactcgttgatctcgcccaaggcggcgaccagttcgcgggtctcggattcggggcgctgccccaggaccttgaccaccgtggaatcgttgagcgccttccaccattgctgttcgcgctggggcagttcgggggtggcggggggacgcggggagtggacgggcaacgccccgcctgcgttggcggcgatggaatcgaggatttccgcctcgcggatgtccaggaggcgcggccccatctcctgcaccttggccaggggcagcggggcgtaatggggcaccagcgccacctgccagtcgtggatcaggtattcgttgatggccttgtacatggccccggccttggtggtcgggtcgttgggatcgccgcccagggtggccttgaagtggcgcttggcgtgggtgcggacgatcatggcgatgacgtcgtgcaccgagcggccgcagcgcagcgccacgaaatcgtcgttcaccgggcgtccgcgggcatccaccagcaggttgcggaaggccgagcggttgcggttgaagatagagatgcagccgtgcagcatctcggaattggccatgaccagttcgtagaactcgtcgcccttggtgccctcaaacgccgggatcagcgagcggaagacatcggctacccgccccttcaaggtgtcgttgatgacgcggaccacatcattgtggctgtggggcgccctgggggtcgcaccctccggcttcgtcacgctgacttcgtcccgtggcatgtgtggcagcccctggtgccggggaatccggcgccagtctcaggttatcgggacatcacctgtgctgcaaagcacaaattatggcactttgtatcgctatccccttgaatagacttgtgtctttatccttttgcatagtccggaaggaggtgggagatggcggcgcgcaggtgaggaagctccactggcttggacaaataggaatccataccggcctggacgcagcgttccgcctcgcccgccagggcgttggcggtcagggccagaatgggggtatggcgggtggtcccgtcctcctcggcacggatggcggcggtcagttggaacccatccatgatgggcatgtggcagtcagtcagaatcaggcagtagggtctggcgcgccaggcggccagggcggccgcgccgtcggggaagacctcggcgggaaagcccagcaagtgaagctgacggcggatcacctgctggttcaccgggtggtcctcggccaccaggatgggggcgccggtccaagcggtggacctgggctcgggctgcggcaagggggcgcagaccggacgcggctgagccaccggaccgatgattcgctccaccgcggcggtgatctgggcacgggtgagggggcgcccgaggaagcccaggcagttggggcggcgctccaactggaagcgatgggccggatcttggccatcgatgaacagcaggggggtggtgcccatgggcgccagatcctcgggcgcgacggaatcggcggtaatcagcgccagatcgaagggggcctgggtggcagtggccttgcgcgaggcggcctcggcctccctggggccgggaacgcggaccacggcggcgccaccctgctcggtagccagggcgatcagggttcgctcctcggtgtccgggtcgacgatcaggatgcgcagcccgatgaaatcggtggtctgctctccgataggcgtttccggcggcacgctctccgccaccggcaacggcaggcggcaccagaacgacgaccccacgccgggctcggactcgaacccggcggtaccgtccatcaggtcgaccagcctgcgggtgatggacaggcccagcccggtgccgccgaaccgtctggtggtcgagctttccgcctgggtgaaaggctggaacagccgatcacgcaaagaggaatcgataccgatcccggtatcggccacccggatggagaggatctgtcgaccttgcccgtcggtgccgccattgcccatgtggatggcgaccagtccctgggcggtgaacttgacggcgttaccggccagattgaacaggatctggcgcaggcgcacgggatcggccagcaggaccggcggcaggccgggatcgacgaaggctgacagggtcagcgacttggccgcggcggctggggcgacggtctggacgacgctttccacgatgcggtcaaggcgaaccggcacttgttccagttccaggcgcccggcctcgatcttggagaagtccagcacgtcgtcgagaatgcgcagcagcgacagcccggactcccgggtggtggagaccagatcgcgctggtcattgtccaattcggtatgatccagcagttccagcatgccgatcaccccgttcatgggggtgcggatttcgtggctcatggccgccaggaaggcggatttggccacattggccgcctcggcgttctccttggcgatggtcagcgcctcgaaggcggaatcgcgcccgcgattggcctcgtggaacttggccagcacgcggttgaaggcggcggcgatctcggcggcctcggtctcgggggcggcggccaccggctgggcgaacgaggcggaatgctcgtgggcctccatctggaccagcaggtcctggagggtacggcggttggcttcctcggcgcggcgtccggcttcggcgcgctcggcctccagccgctgcttttccagggagttgcgcttgaacacctcgacggtgcgggccatggctgccagttcgtcgtgcaggtcgcggccttccacctcgcgcgaccagtcgccgccggccccggcctccatggtctcgcgcaggcgctgcaggggcgagcggatggactgcccgatcatccaactgacccaggcgcccaccagcagcagggcaagggcggcgccggcccccgccgccgccagccgcagcaactggtgccgcgagcggcgctgcagccgttcctcgcggtcgcggccctgggcgatcagccggtcgatggcggcggacatcaccgcctgattggcgtccacctcgtcggtcagaatgcgcgaacgctcgtcgaatccgcgggcaatggcgtcaatggccgccgacagcgtgcgcgcccgcgtgccgatcaccgccagggcgtcgcgctgcaggtcgctggtggccagcccggtcagggcggggacggtgtcggtcacccgccgcaggctggcatgggcgttgatggcgccgggcgccgccccgttgaagtagaaggcgttgatggcgatcagcgcctcgacgaagttctcgtgcgacttgaccaaagcggggctgagcggatcggtgccccgggagcgcgccgtggagttcaggatggcgtaaaggcccgacatctcgctggtggattgcagcacgtcgctttcgtacaggcgcaggatatcggcattgatggccttcagggtctgaaagccggtgacgaagcgccgcgccgcctgatgcatggtgctggcgtcttccgacaggggcttctggtgcgcggtggcgtcgcccatggccacgaacagctcctccgagcggcgcatggcgtccttcagcaggtcgtcggtgggattggccagatactggcggatcatgccctgcaggcgcgaggcgcggatgtcgatctcggccagggcggaggtgcggtgctggacgatccgcagctcgtccaggtcagaatccatcaccgaggcggcgtgccagcccaatccccccaccgccagggcgacgaacacgttgagcgccaccaccagcggaatacgccaggcgatgggcaaagccctgatccaacgaacgaagcgcgtatacgccatggccggcggaatccccatccttcgcctctcgggctcatggtacaagcggaacaggggcggggaaagctggtagtcgtgaattcgcgtgccgccaggaaaagttggtgccggcatgggcgccatgtcttccggtcggcttgaccaaaatcacatattgccccagcatgttctcggttcacccaaatttaatgtggatatgcgccgccatgcgtctcaccctgcataccgattacgccctgcgtgtcctcgtccatgtgggacggcatgacggcgacctggtcaccatcaacgaaatcgccgaatgctacggcatttccaagaaccacctgaccaaggtggtgcatcagctggggcgttcggggtacctggagacggtgcggggcaagtatggcggcgtccgcctgctgcgccagcccgaggacgtcaagctgggcgagttcatccgcgagaccgaggaggatttcgccctggtccgctgcatgcgctgcgacacccccgacgaatgccggctgaatgccggctgcatcgcccgtgacgccctgtcctcggggctgtcggccttcttcaaggtgctggacggctataccctggccgacatgctggagcacgagcgccaggcggccgagtagtctttccctacggatgggttttctctttattgcatctggtgtatccctttgcgggcatcgagtcttggggggaacatggccgcgtttgataccgccgacaatgaaaacgaactccgggtcatcaacgagttcctggaggaattgcgcgacaccgccagccagcttcaggtgctggtgggcaatatgcgctccaagagcattggcgccgccgagggtctcgccaccctgaagcgcgaggccagcaacctgcgcagccatgcccagggtctcagcctgcccatgatcaagctgatcacccatcgcttcgacgagtatgtgggcgagttaaaggaagccggcccctccgagctggaggagattcaggtcttcgtcgacaagatcgagaagctagccgacggcgagcagatttccgaagccgatgctcccgccgtggtccgcgccctgccggccaagcgcacggccgacatcgatttcggcaagatcgagaagaagaacgtcgagatcctgctggtggtgccggaaaaggccatgtcgcgcatcgtcgagcgcgagctggcggcctgcggctatcgcacctcgaccatccgcgacggctttgccgccatggagaccgtggtccggacccgtcccgacatggtgatcgcctccatggagctgggcctgctgtccggcgtcgatctgggctgtgccctgggctccatgccggtgaccgagggcattcccttcgccctgttcaccagctacgaatggggcaatcccaagctgaagggcctgccgccccgcgcctcgctgatccgcaagggacccaagttcggcgacgatctggccgagagcctgtcgcggttcaatattacctgacagagattgggggatcgggaagcacagcttctcgatcccttcagttttttataaaaagactggtggctcggaggctgtgcctccgaacgggtcagggcggtcgccctgccgggaagcgggggttttccgcgtcctcgcctagaccatcgagcgtcaaatatgacgcacgatggtctaggcttatgttcgtccctcgccgggcgggcgctctcgcgcccttggccgcggcctcaatggccgcttgagcatcctgcgtcagatttaacgcaggatgctctaaatcccgcccatgcacagatacttgacctcgaggaagtcctcgatgccgtatttggagccctcgcggcccaggccggattccttgacgccgccgaagggcgccacttcggtggagatcaggccttcgttgatgccgacgataccgtattccagggcacgcgacacccgccagacccggccgacgtcgcgggaatagaaataggcggccagcccgaattccgtgtcgttggccatgcgcaccgcctcctcttccgtcttgaagcggaacagcggcgccaccgggccaaaggtctcctcgcgggccggggccatgtcgggggtgacgtcggccaggatggtgggctcgaagaaggtgccgccgcgggcgtggcgcttgccgcccatcaccacccgcgcccccttggccaccgcatcggcgatgtggcgttcgacctttcgcaccgcctcttcattgatcagcggaccttgctggaagtcgccttccaggccggggccgaccttcagcgcggccaccgcctcggccagcctggcggtgaaggcgtcgtagatgccgtcctgaaccagcaggcggttggcgcagacgcaggtctggccggtgttgcggtatttggacgccatggcgccggccaccgccgcatccaggtcggcgtcgtcgaagaccatgaagggggcattgccgcccagttccagcgacagcttcttcaccgtggcggcgcattgggccatcagcagcttgcccacctcggtggagccggtgaaggagagcttgcgcaccttgggattggcggtcagctcaaagcccaccgccttggggtcgccggcggtgatcacgttgaacacccccggcgggaagccggcccgctcggccagttcggccagggccagggcggagagcggcgtgtcctcggccggcttgaccaccacgggacagccggcggccagggccggcgcgcatttgcgggtgatcatggccagggggaaattccagggcgtgatggcggccaccacgccgatgggttccttgaccacgacgatgcggcggccgggcatgtgttcggggatggtgtcgccatagacccgcttggcctcctcggcgaaccattccacgaaggaggcgccataggccacctcgcccttggcctcggccaggggcttgccctgctcggcggtcatcagcttcgccagatcgttctgggcggccatgatcagctcgaaccagcggcgcaggacggcggagcgctccttggcggtcttggccttccacgggccccaggcccggtcggcggcctcgatggcctgcctcgtctcggcggcgcccatggcgggaacgcggatgatcagcgatccgtcggcgggattggtgacggcaaggcgttcacccgattgggccgcgacccacgagccgttaatataggcgtgatcacgaagcagggcagaatcggaaaggtcaagcatggcatccatccaagccgggggcgcaacaaggtatactcagccgcttcacaacgcaaaggggggcgccatgaccctgccccggtcccgctacctctccgtcatgggacgggagttccacctcaccgaatggggggatgacgccgcgccagccctgatcatgtggcatggcctggcccgcaccgggcgcgacttcgacaccctggcggcccatttcagcgaccgctaccgggtgatctgccccgataccctggggcgcggcctgtcgggatggtcgcgggcgccccggcgggactacaccctggacacctatatgcggcatgcggtggcccttctcgaagccctgggcatcgaacgcctggactggatcggaacctccatgggcggcgccctgggcatgctgctggcggccgggcccttgaaggggcggatgacccggctggtgatgaacgatatcggccccgccctcaatcccgtggcggtggagcgcatccgcgcctatctggcccagcatcccagctttcgcaccatgaccgagttcgaggccttcgtgcgccaggtctacaaaccctacggcttccagaccgacgccgaatggcgccgcatgaccgagacttcggcccggcggcggggcgacggacgcatcacgccccattatgatccggcggtcatgcgggtcttcgcggaaacagccggcgattacgaggtctgggccgaatacgacaaggtggaatgcccgaccctggtgctgcgcggtgtcgattcggacctgctactgcccgaggtggccgacgagatgacccggcgcggtccccgggcccggctggtcacggtccccggctgcggccatgccccggcactcaacgtgccggagcagatcgcggtgctggaggagtttctagactgaccggtctgtcatcatgggcgcgagtcccacgtcgctcgggataagggcgccgagcccttgacgtaacgtgtcatcccgagcgaagtcgagggatctcgtcctggcatggcttttcagaaccggcaccgccatatcaggcggagatccctcggcttcacctcgggatgacagggtgatgggctcaccccttctggggctcgatccgcaatccggtcagcaggaagacgtcgcggggggtgagcggcgcctcggcggcgaggcgcccgccggccaccgcctcgggctgcgggcgcttgcggatgacgaactcgatggccgcctcgcccaccggggtcagggtctggtcgaagcggggcagccgatggcggaagctgccgtccagggcctcgatgcggcggatgtcggcctggatgcccagggagggcagggcctccagcagattgaccgagaccgggctccaggatttcggcttgaacagggtgaaggtccagcggtgctcggggttatggcgcgacggccagtagccctgttcgtacatgtcctcatcggggaccagcaccaccatgtggccgccgggcttcagcacccgcagccagtggcgcagcgcttccaccggcgaggccatcttctgcaggacgaaggtggcgtgcacgaagtcgaaactggcatcggcaagcccggtcaggtgctgaaggtcgccatcggccacgtcccagaccttggtcgcggtgatgctgggaaacagctcgccataaagggccaggggatcggcggcgccgccgatgtccaggccctggccgaccagatagcgggtgatgaattcgggggtgcgcgcccggcgggcgacggatttgctggtctccttcaccggatcactccacggcctgtatcttgtcgaggatgtcgccgccgcccggcacatggtcgcggaacgacttccaggcagtgcgccgcgccagcttgcgccaggcgtcgaaggcgtcgaaatccagtttgaccacgtccactcccgcggcgatgaaattgccggccaggcgccgctccagcagcgacagggagacggccagattggcggcggcttcggcggcggcggcgtgcagtgcctgtcgccgggcttcgtccaaggtgtcgtagcggcgcttggacaccatgatcggctcgtagagataccacagggcacccgcatcgcccgggaccatcaggcaggcgaacttgcgctccatgtggagtgacagcaaggtggcggccgaggtattggcgatgtcgatcaggtcgttgctgaccagggtgcccagcgagtccgaggtgacgaccggaaccggcacggccccggcccccgcccagaactcgcccatgaagcggccgatggtccgggcccgcaggcccttggcgtcggcgggggtctggacgcagcgctgccggctggcataggcgccgggaatccaggaatcggccaggatgaccacgccggcggcttccatctggtgcttgagatcgcgcatggcgggcgaggcggcgatgcgctcggcatgggggcggctgcgcaccatggtcggcagggacagcaccgccagttggggcatgcggtccaacagatagtcggacggcatgaacgccatgtcgatattgccgctggtcagggcgccccactggtcgccgggacgcagcagggaggccgaggcataaaggcggatggtgatcccctgggcctccatggcccgggcgatgctccgcatggcgtcgtcgcgcatgtctcccggcgggaattgataggaggcgatccaggtctcggccccggcatgggagacggggcgcacggacacgaccgcgagcgcggccataacggcagcggtcatcagcctcagtccatgcctcagaatgcgtcccagcaaagcgccgccgcccccgatgatcccccgggtgacagtgcaccacgttcgcgggctttgggcaactattcccgaaggccggactcgtcgcgggcctcttcctcggcctccatctcctcgaccacttcctcgggcagcatcagcacgccggcattgtagtcgtagtcgaagatctcggcgtagcggccccaggtgatggtggtctccagcacgcgctcggcctcgtcgtcggtgaggtaatcctgcaattcctgcaagaagcggtcttccggggcgcgatggtccttgcgctcgtccagcacccggcggatatgggcggccaaggggatgtgcttgaccagggcctcggcgaacaggtccttgcgcaccgcgtcatcggcctcgacgaaggcctggccggcgggggtgacgaagatgtcgcccgccgcgatgcgggccagccccaggacgcgcaggccttcgaacaggtggaagagctggtcgtcctccagctcggtctcctcggccagttgcggcaggtcggcgcggccgttgaacggcgcctcggccacggtttccagcaggccggccatcttgcccggcgtggtgtcgggcaggcggtagcccagggtcaactgctcggccgcccccaatccgccgccccggacgttggcggtcatcagggtgtagacctcgtcgacgatctggcggaaggcggcggattccgtgtcgcgcggccggggcaggttgacgcggatctcggcccgcacccgcccggggtcggaggagaataccaggacgcggtcggccatggacaccgcctcctcgatattgtgggagaccagcagaatgcccttggtggggatcttgcgctcgtcccacagttccagaaggtcttcccgcagcgtctccgaggtcagcacgtccagcgccgagaacggctcgtccagcagcagcacgtcgggccgcatcaccagggcgcgggcgaagccgacgcgctgacgcatgccgcccgacaattccttgggataggcgctttcatagccgcccaggccgatcaggtcgatggcctcgttggcgcgctcttcgcgctcggccttggccacgcccgccgcctccaggcccagttccacgttctcttccaccgtcagccagggaaacagggcgaaagactggaacaccatggagatgcccttggccgggccggtcatcaggtggccgcgatacttgacctcgccgccattggccttgatcagcccggccatgatgcgcaaaagcgtggacttgcccgagcccgacttgcccagcagggcgacgatctcgccctcttccagcttgaagtcgacgccttccagcacggtgcgttcccgccggtcgggcgtgagaaaggtcttgcgcacgccgcgcaggtcgagaagggcggtggaggtggtgatgtcggccatgaccctgtcctctaatccagacgcagccggtcggccgccagcatgtaaaggcgccgccacaaaaagcggttgaagcccatcacgaacaggcacatcacggcgatgcccagcgcgatgcgcggaaagtcgccgtcggcggtggcgcgtgcaatgtacgagcccagccccacggcctccaacttggtatcgccccagctgaccagctcggagacgatggaggcgttccacgacccgcccgaggcggtcaccgccccggtgacgtaggacgggaagatggccggcaggatgaacttcttccagcgcagccagcccgacaggcccagattgcccgccgcatccttcatgtcctggggaatggccgaggccccggcgatgacgttgaacaggatgtaccactgggtgcccaggatcatcagcgggctggtccacacgtccacattggcgtcgaaatggacgatcagcaccacggccaccgggaacatcaggttggcggggaaggcggccaggaactgggccacccattggacgttctgggccaccagcggccgctggccgatccatacgcccaccggcacccagatcagcgaggccagcgagatcagcaccaccacccgcagcgcggtggtcaggccgtaaagcagcacctgccatacttcccacaggccgatggccccatggatgaacagccccacttcgaccagggcgcccaaggccgccaggatcagcagcccgtcccagacccgttcggcccaggagggcagggtcaccatgcggatcggcgcgtggtggaacagggtggtttcctcgcgctggcgcagcaggaaggtgaaacggtcccaggccgccgacggcaggcgggcgaggtagcggaacaggcgtccgcgctgcatcagggtcagcagccaggattccggctgctgctcgcccggtgccgaatccaccttgaacttgtcggcccaggccaccagcgggcggaacatcagctggtcgtagatcatgatgccggccagcaccgccagcatggcccagccgatggccgccaggttctcctcggcgatggccagggcgatgtacgagcccacgcccggcagggcgatgctctggcccgacaccgagatggcttcggacgccaccacgaagaaccagccgcccgacacgctcatcatcatgttccacaccaggccgggcatggcccaaggcagctccaggcgccagaagcgttgccacggcgacagatggaacatctccgaggcttcgatcaggtcgttgggcaccgtcttcagcgaggaatacaggctgaacgtcatgttccaggcctgggaggtgaagatggcgaagatggccgcgcattccacccccagcagattgccggggaacagggcgatgaagccggtcaccgtgatggacaggaagcctaggatggggatcgactgcaagatgtcgagaatggggatcagcaccttctccagcgccggcaccttggcggccagggaggcgtagatcagggtgaagatcagcgaggccagcagggcggcggccatgcgcaacgcgctgcgcagcaggtaatagggcagaccggccgggtccagggacagggcgagcttctcacccacgtcatagggcgtggtcatctgggcgccgccataggccagcagggccagcagcgcgaagatgatcggtatgatcgccagatcccagaaattgggcttgagttctggcgccaccgcgactgtgggaaggctccaacgcattccggccgttccggttcgggttgagtgcgcccctcatagcctgcccgccttgcctttgtcgagcagggaaacctttacaagacggtgactgtcaggttgcggtcaggcccggtcgagaatcacgaagtcgaaggccgggtcgccctcgttgcggcgccgcgaaacttcatgccagaggccgcgctcgaaggcgggaaacatcgtgtcgccctcataggcgcgggcgatctcggtcagatacaggcgccgggctccgggcagggcctcggcgaacaggctgttgccgccgatcaccatcagctccgccgcctcgggcgccagccgggccgccagggccagggcttcgtccagggaatgggcggtatgcgccccctcggcccgccacccggtctggcgcgtcaccacgatgttggggcgcttggggagagggcggccgatggactcccaggtcttgcggcccatgatcaccggcttgcccagggtgttctccttgaaccacttcaggtcctcgggaatatgccagggcagggcgttgtccttgccgatcaccccgttggcggccacggcgacgatgagggcgacggagggggtcattgcttgtccctcaatcgccgggcgggcttgtaccaagcccttggctcccgccgcataagcggcggcgcgcttcgcgcttgcctcctcgctccgctcgtcggactcataccgccaccggtgcggcgatgtgggcgtggcactggtagtccaccactttgatgtcgtccatggtgaaggcgaacaggtccttcacctcgggattgagctccagccggggcagcggcaggggggcgcgcgacaattgcagcgccgcctgctccatgtggttggaatagaggtgcgcatcgccgaaggtgtggacgaaggcgccgacctcgaggcccgtcacctgcgccaccatgtgggtcagcagggcgtaggaggcgatgttgaacggcacgcccaggaacacgtccgccgagcgctggtaaagctggcacgacagctttccgtccgccacgtagaactggaacaggcagtggcagggcggcagggccatggactcgatatcggccgggttccaggccgagacgatcaggcgccgcgaatccggggatttgcggatcatctccaccacctgggtgatctgatccacggtgctgccgtcggggcaggcccaggaccgccattgcttgccgtagaccgggccgagatcgccattggcgtcggcccattcgtcccagatggagaccttgttgtccttcagccagccgatattggtgtcgccccgcagaaaccacagcagctcgacgaagatggaccgggtgtggagcttcttggtggtcaccaggggaaacccccggctgaggtcgaagcgcatctggtggccgaacacgctggtggtgccggtgccggtacggtcggtcttggtcacgccttcggcttgaatgcgccgcagcaggtccaggtactgatgcaaggggtgaacctccggatttggggcggccggcactgtaccagcccggccgaccgggacgcaatgtcgggtccccgccttctttcgccacgggccgtcacgtcttggtcggagacaaggaaggaaaacaaacttaagatataagtgggcgaaaggagtgccgcgtgggtttcgacaccaagacgttatggatcaccctggccatcagcaatctggtgttcggcgccctgatgctggtttacgccggtcagggaggcagccgggggacgttgcgcagttgggcttcggcgcaggtgttcaaggggctggccatcgcgctgatcctggtcaagccggccattccccatccctggggcttttccggcaatctgctctatctcgccgggcatgccttggaactggcggcgtttcttgcctatgccgggcaggggcggcgaattcgcgcggccggtctggtctttgccggcctggcggcggcctatctggccggaatcgccgccggggcggcggccaatgtcctggcggtgctgttctcgtccagtctgttcgtcctgtacggattgagcgccatggccctgtggtcgtcgcgccgtcgccggtcgccggtccaggttctgctggtggtcagcaacgggctgatcgccctgaccgccctggcccgcatcgggctggcctggtccagccccgcctgggatccgcagagcgccgccctggccaatcaggccatgttcctgctgggctacgtcttctcgctgtgcgacggcttcagctttctgctgctggtcaaggaggatgccgaccgttcgctgctgcgcatggcgaccatcgaccagttgaccggcattcccaaccgcgcccatttcctcgatctggccgaggaccggcggcggctgtgcctgcggtcgggccaggccgtctcggtggtgatgatggacgtggactatttcaagcgggtcaacgacgagttcggccactccgcgggggacgaggtgctgcgccgtgtcggctgcgccctgcgcgagcatctgcgcgatgtggacgtctttggccggctggggggcgaggaattcgccattgtgctgccgggcacctcgctggcggcggccgttccggtggccgaccgtctgcgcgccattctggccggattggaggtggagaccgccaaggggacgacccgaatcacggtcagcatgggcatcgccgacctgggcggcggacggtccctggaactggccatgtccgaggccgacgggcggctgtaccgcgccaaggccgccgggcgcaacaaggtggtggctgtttccgaaacaattcccgacaaggctggcgcttccgatcgggccgctttatagtggggatgccgggcgaccggctatgacgctaaacgccacacggaatagacgttacggacccgggggcggtacccggcgcctccaccaaatttcccggcccaggacgcgggccggaacatcgggggcgaaacaggatcgacgtgcgcagtaaaggtctggtttgcgttcggcatgataccaccgttatcgggtcaatcctaacaagtgccaacgacaacgttgaacttgccgctgcggcttaacccgtaagcgcggtccggggggaaccgggcaacagaactccccccacttttccgggttccgatgacacccgtcgtcggaacgcggctaggcccaaagggccgcgcggcttatgccgcgggagccaagcacgcggaggcgtgcgcccggcgcctgaggggcgtcggcaagtgatacgcgaggatggggtttttcgccggtggaagaactgcgttacgacaagatggtggaagaggctctgcgcggcgttgtgcgcgattcgctgcattttgccgctgaacacggcctgccgggcgagcatcacttctacatcacctttcgcccccaccaccccgatgtggggatgagcgaccacctgaaggcgcgccatcccgacgagatgaccatcgtgctgcagcaccagttctgggatctcaacgtcaccgaggacggcttttccgtgaccctgtcgttctcgggcaagccggagaccatggtgatccccttctcggcggtgaccggcttcgccgatccttccgccaagttcggcctgcagttccaggccattcccggcgatgacgacgacgacgacgacatggagatcgacgagttcgatccccagccgccgcgcggcgccgcgtccgccaaggacgacgagcccgagccccagcccccgggcggcgacggcaacgtggtggcgctggacaagttccgcaagaagtgagtttcaagggctgctgcttccggccgcccttgacgttgccgccaaaaaggtgtttgacctgactccgccgttccacccctgaagggtagggcggcgctacccgtttcattcagaccgaggtcgccggccatgtccgatttcgccttccacgagctgttccccctgtcccatgacgacaccccttaccgcaagatcaccgcggagggcgtggggaccgccagcttcaacggccagagtgtggtcacggtggcccccgaggcgatcacggccctgaccaaggaagccatcaaggacacctcgcacctgttgcgccccgcccatctgcagcagctccggaacatcctcgacgatgccggctcgtcgcccaacgaccgcttcgtggcctatgacctcttaaagaacgcctgcatcgcctcgggcggcgtgctgcccatgtgccaggacaccggcaccgccatcgtcatgggcaagaagggccagcgggtgtggaccggcggcaatgacgaggccgccatctccaagggcgtgcaggaggcctataccgagctgaacctgcgctattcccagaccgcgcctctcgacatgtacgaagaggtcaacaccggcaccaatctgccggcccagatcgacctctacgccaccgagggcgaggcctacaagttcatgttcatggccaagggcggcggttcggccaacaagaccttcctgtatcagcagaccaaggcgctgttgaaccccaagtcgttgctgtccttcctggacgcccagatccgcaccttggggacctcggcctgcccgccctatcacctggccatcgtcatcggcggcctgtctgccgagatgtgcctgaagacggtcaagctggcctcggccaagtacctggactcgctgcccaccgccggcaacaagttcggccaggccttccgcgacctggagctggagcagatcgtcctcaagatgacccaggacatgggcatcggcgcccagttcggtggcaagtacttctgccatgacgtgcgcgtcatccgcctgccgcgccacggcgcctcgtgcccggtggccatcggcgtgtcctgctcggccgaccgccagatcctcggcaagatcaccaaggacggtgtttatgtggaggccatggaaaaggacccggccaagtacctgcccgacgtggacccctccaagctggcgggcgaggtggtcaagatcgacctcaaccgtcccatggacgagatccgcaagaccctgtcccaatacccggtgaagacccgcgtgtcgctcaccgggcccatgatcgtggcgcgcgacatcgcccacgccaagctcaaggagcgactggaccgtggcgaaggcctgcccgagtatttcaagcagatgggcgtttactatgccggccctgccaagacgccgtccaatttcgcttcgggttcgtttggcccgaccacggcggggcgcatggattcctatgtggatcagttccaggccgcgggcggttccatgctgatgatcgccaagggcaaccgctccaaggcggtgaccgaggcctgcaagaagcatggcggcttctacctgggctccatcggcggcgccgccgcccgtctggcccaggattgcatcaagaaggtcgaggtcatcgagtaccccgaactgggtatggaagccatctggcgcatcgaagtggtcgacttccccgccttcatcgtcgtcgatgacaagggcaacgacttcttcgccgagttcgctcactgaggtttggggcggtggccggtccgctgacgcggatgggctgccgccctggcccgcctggagcgatgctccagacctccttgtcgtttgccagacctccttgtcgtttgaatgggggcgaaccgtcgtgtcccgccaattcgccgatcacgtctgcgacatgctgtcccccctcgggtcggtgacggcacgggccatgttcgggggcttcggcgtctatctcgacgggctgatgttcggcctgatcgcctgggacaccctgttccttaaggccgacgaccgcaaccgccccatgttcgaggaggctggggccgggccgttcaagccatgggaggacaagcccatggccatgccctattgggaagtccccgccgatatcatggaggagggggccgaactgtgcgcctgggggcgcgccgcctttgacgcggcgctcaggacccgcaagcccaagaaagtggccaagactctttccgctggcaaacgcccgcgctgaggctcactctgttgcagagtgcgtcttattcgcaaagggcattgcccatgcctcatcgccttcgcgttcccgtctgcaagcccgccccgccgccggccgacctgcccccggaggaggggggcgggcgccccatcgccctgtccatctggcgcggcgcccggcggctgtgtccccgatgtggggtggggatgatcatggaagggtatctcggcatccgggcggcctgcccccattgcggcgagcgcctgggccatatccgggccgatgacggcccggcctatttcaccgttctggtcgccggccatgtggtggtgccgctgaccctggccgccgagcaagcctggcatccacctctggaggtccagatggtggtggcgctcagcgggctgggactgctgatctggcggctgctgccccgcatgaagggggcggtgctgggcttgatgtgggcgcacggcctcaagggcgacgaagtccagggcgacgtggagcgtcacgggtaagacaaatcccgatgagctaaactcatggggatttggttaggcccaaagggccgcgccgcttatgcggcgggaggcaagggcgctcgcgcccgcccgcccgccgattgagggcgatcctgatgatcggttgagatcatcgggatctggtataagacggggctgccgcctcccgttctcggtgagatgggccccgcttggagaccatgtctccaaacctctcttttattcgttcataaaatcaaaagggggggcggggttctccccggtgggtttgggcaaagcccaattgccaagccaagtgatcctcagttggcgaccagccgatatccgacgccgtgcacggtcaggatgatggccgggtggcgggaatccgcctcgatcttgcggcgcaggcggccgaccagcacgtcgatggtgcggtcgatgaccgcctcgccgtcatgctgggtgagatcgagcaactggtcacgggtcagcgcccgcccggcattgcgggccaggcggccagcacgtcgaactcgccgcgggtgaggcgcaccagttcgccggtgggcgaggtcagctggcgggcgtcgcaatccaggcgccagccggcgaaggaatggatgccggtggccgagcgctcggcggccatggtgggggcgacgcggcgctgcaggttgcgcacccgcacggccagttctcggggattgaacggcttggtgatgtagtcgtcggcaccgatctccaggccgacgatgcggtcggtctcgtcctgacgggcggtgaccaggatgatgcccaccgacgacttggcgcgcagctcgcgggccaggatcaggccgctctcatcgggaaggttgatgtcgagcagcaccacgtcgggcaccgtcttggagacgatggccttcatgtccttggcgtcagcggcttcgctgacctggaacccttcccccgtcagatacgcggcaagctttgcgcgggtaacgggttcatcctcgacgatcaagacgtgtgcttttgtcgacactgcattctccggccgacgccccggctagtattcatcacccgtttacagggtattgccgcacaattcaatcactgccgtaattccattgtgaagttgcgcctataaaagctccactggttttcccgcccagggctggcgggatggaggggatgcggtgtctcggcatattccaatcatcgggcgtctggacgacggggcgggctttggccgtgcctccgccgtaatcggcgccatggtgttggtgctgttctggctgagcctgggattcgacaacggcatcgagcggcaattttcctcggttccggcggcgccggccgtcgatggcggccgggtgggaagcctgctggtggcggtgctgggccccctgggtggcggcgtgctgctcctgcttctggtccaggtggtctgctggcagcggcggacggccgaacgtctacgcctcaaggaggtcgaactgaccgagcagcgcgacaggctacgccgctacgtcgccgacctggagcgaatcgccgacgtggccgcccatgatcttcaggaaccgctgcgccgcatggtgtcgtactcccaattgctggccagtcatgatcaggccggctgcgacgatgaggttcgggactatgtcggtcacgtggtcgatggcgcccggcgcatgcgggcgctggtcagcggccttcgcgaattcgtggcggtggactctctgccgcggaccggcgaggtcagctcggcctgggtcgccatgacggtggcccgccagcgcctggccgacaagttggccgatgcgggagtgaccctggtggtggacccgttgcccgaggtggaggccgatccggcgtcgctggtggagatcttcgtccagttgctcgacaacgcggcgcggtatcgcgcgcccggccggcggccggtggtccatgtctcggtggtgcgcgacggcgacatggccaagttccaggtgtgcgacaacggaatgggcatcgatccggcccgggtcgtccgcatgttcgagattttctaccgtcctcatggtggcgacggccgggcggctcccggcgtgggcaccggcctggcggtggtccgccgcctggtggaacgccttggcggcgccgtgtgggtcgaatcggaaaacggcgtgggaagcacgttcggcttcagcttgcggctggggctgtccctgccggaccgggggagagaagacaaggccgcctgagcggcggatacaattgaggtggcgacgccgtccggcgccgcttcctcggtggcacggtcagcttgcggccatccccgaaccccaaggccgcgggcaggatcgtaagaggagggggcgcccccaacgtcccctcctcgcagccactgaaactcaagagacgttccttcgcggccatccccgaaccccaaggccgcgagggggcttggagagggagcggcccccaaacgctccctctccttcattccaccacagtggttttaacaggctgcggaaaagccccgcttcgcggcagggctaccgccctgacccgttcggaggcacagcctccgaaccaccagtttttcaagaaactgaagggtccgggaagctacgcttcccggttgggagaccgggggcgaaagcccctgcggtgacgcttttccactgcctggtaaaccggacggccgtgggcttgatccggccttccatgatacgagccggcgggatcagtcggtccggccgggaagctcggcggcggggggcaggtgagcccctgcgatccggttgagatggctcttgagcctgagaagggtggcgacaagttccatccttgcctctttctgctgggcatccgaggtcttcgggctgggaatggtggtcaggcaggccagcgcctcccgcgccgccaggcggatgtcggtctcgcccctgcgcgccagctcgtcaatggccgcgatctgccccttggggtccgtctggaaatcgttgcgcagaaaaagctcggaattgttgtcgtcgtgatgaatgtaggcgtgaagcccggcatcatgggcgctgagctcgttcagcaagatcatgacgaaccagcccagggtgatctcggtcagattgatgccgcgccgggtcttttgcagaaaggtctccaccttttccacgtcggacagcatgtcctggcggaattcctcgcgctcctcggggctgaactccggcggcggcggcggcggggcggcgcagccgagcagaacggcgaccatcaggagggcgacgacacgacgcatggagcgggctcctagggcctgagggggcggggcgcccgctcaagggcggccagggcgccgctcagggtgggaaaacgcgaaacgacgcggcccgatcttgccacgctccagcaggagccccgggtgccgggagccgatttggtgaccgtatacaaagggcgttcctgggcgtgacggaagaccgagaagacggcgccgtccggcaggacgtcaatggcatagtcgcgccactcgccgcaggccacgcgggtggcatagagtgtcagcaattgggtaatctcgccccgctcgaagtgaacgaagccggcttccccccggtattccgccatccggatcaatgttgccatcggccaccccgccggtcctgtatccttcgatactgtcgcgcagcgacgtttgtctgtcgagggttttacgccgcccggtcagcgaaccggagtcgaagcgggaacgaagccgatcagacggtcgttgccttcgttgtagggctgggaatagcaggtgggccgggccagggtgctgtagcaatagacctgggccggcggggacgggcggtcgggccagtcccggcaatagccttcgccgcgctcggcccgcgggctcgagcaatccttgccggtgatccagccgatgacatgatcgcccatggtcttgtgggtattgatcaggctgagcgcttccagctgcatgaaggtataggaattgggcagcggacgcggcccgggattgatcgagcctctctcgccgatccaggcgcagccggcgaccgccaggactcccaatattgcaagaacgcgcccgatcatttctatgatcctgctaagccattgagctatattgtgagaccatgccagacgggaatcaatgggcagattctgccgggaggaaagatggcggtgacgacgccggcttgcgccgaggattgggtggcgcctgatttcgccctgccgggagtcgacgggcggacgtggcgcctggacgatgtccgcggcgcgcggggcacggtggtcgccttcatctgcaaccactgcccgtatgtggttgccatcatcgaccggctggtccgcgacgccgacctgctgcgcaaagaggggattggcgtcgtggccatcagcgccaacgatcctacccagtaccccgaggattccttcgacaacatgaaggtcttcgcccggactcactgtttcggctttccctacctgttcgacgagtcccaggaggtggcgcgggcctatggcgccgtgtgcacgccggacttcttcggtctggactgtctgggccgcctgcgctatcgcggccgtctcgacgaatccggccgccagccgggcacgcccgatgcgcggcgcgaactgctcgacgccatgcgcctggtggcgcaaaccgggcgcgggcccgacaaacaggtggccagcatgggctgctccataaaatggcgcgacccgtagaggtcgaggcgacggcagtgtttgccaagggggccggggcggactatgttacggcgcggctccaggacacaatgccgggagcgtgaccgcccgcatggagtagagttccttgaccgacaagcacgaagatgccgccaccgacctcctgatcaaggaagtggacgaggatctgcggcaggaagagcttaacaggctgtggaagaagcatggcggcctgtttgccgccgccgccctggccctggttctggccgtggctggctggcagggctggcagggctgggaggccaagcagcgtcaggccgcttcggcccgctattccgagaccgccgccctgatcgagcagggcaagaaggacgaggcggtcgaggtgctgaacaagctgtcggccgaggggcccaagggttaccgcctgctggccgacctgcgcaaggcggacatggcccagcaggccggggatttcaccggcgccgccgccctctacggcaagatcgccgcggatacatcggtggacaaggtctatcgcgacatgtcgaccatccgggccgcctatctcgttctggatagcggggacgtggccgccatcgaaaaatcggtggagccgctggcggcggaggccagttcctggcgccattccgcccgcgagattctggccctggccgccttgaagcgcggcgagacccctcgtgccgccgaactgttcgccaagatcgcggaagatgccgccgcgccccaggggctgcggacccgtgccgccgaaatgcttgccgccaccgggcaacgcgccaggagctgattcatgggaatgaccgtcatgacgcgcaggatcgccggtgttctgatcgccgtgctcgctttgggcggttgcgagagctggctgggcgagaacaaggcgcccccgctgccgggcaaacgcatttcggtgctgtcgcgcgaaaagatggtcgagcccgacatcggcggcggcctggccaagatcgttctgccaccgcccgaggataacgaggactggccccaggccggcggctattccaaccacgccatgcaccacatgctggtgggcgacgccctgcagcgggtctggaagagcgatgccggcaccggcgccggcaagcgccgccgcctgctgggccagcctatcatcgccgagggcaagatcttcaccgtcgacgcctcgtccatggtcaccgccttcgatgccaataccggcaagaggctgtggcggaccgagctgacgcccgatgacacctccgaggtctataccagcggcggcctgggctatgaggacggccaggtcttcgccgccacgggctttgcccaggtggtggcccttgatgcccgcaccggcaagatcgactggcggcagaccgtttcggggccgctgcgcggctcgcccaccgtgcgcggcggccgggtgttcgcggtgaccgtcgacaaccagacccatgccctggcggccgaggatggttcggtgctgtggacacatgccggcatcgccgagtccgccggtctgctggcggggaattcccctgccgtcgacggcaacatggtggtagttccctattcgtccggcgagttgtttgcgctgcgcgtcgagaacggctccatgatctggcaggattccctctccaccgtgcgccgcaccgagaacgtgggggcgctgatggatatccgcggccgtcccgccatcgatcgcggccgggtctatgccatcagcaacgccgacatgctggtctgcctggaagagcgcagcggccggcgcatctgggaaaaggagatcggcggcgtccagagcccgtggatcgccggcgactatctctatgtgctgaccaacagcaatgaagttctggcccttgaggccaagaccggccgcatcgtctgggtgaccgagatgcagaattgggagaaccccaaggaccgcgagggccgcatcgtctgggtcggcccggtcctggcgtccgaccggctgatcgtggcctcgtccgacggcaagctggtgtcgctgtcgccctataccggcgacatgctgggctgggaggaagctcccgccgccatcagcatcgcgccgatcatcgccaatggcaccatgtatttcctgaccgacgacgccgacctcgtcgcctaccgctagagttcatttcatgccgtttaccgttgccatcatcgggcgccccaatgtgggcaagtccaccctgttcaatcgtctggtgggcaagcgtctggccatcgtccatgacctgcccggcgtgacccgcgaccgccgcgagggccgagccagtctgctgggcatggagtttcaggtggtcgacaccgccggcttcgaggacgatggcggcgattccatcgaggcgcgcatgcgccaccagaccgacatggcggtggccgaggccgacgtggccctgctgctgatcgattcccgtgccggggtcacccctctggaccgccacttcgccgaccatctgcgccgcctgcccaccccggtgatcctggtggccaacaagtgcgagggcaaggccggggcaccggggctgtatgaatcctacggcctgggcatgggcgagccggtggccgtttcggccgaacacggcgaaggcatgtacgagctgttcgaggcgttgcgcgatcacgccatcaaggctggggcgctgacccccgagggcgacgaccccgagcccgaggaaccggccgagggtgaggacggcgagcccgatcccacccgtccgctgaccatggccatcgtcggccgccccaatgtgggcaagtcgacgctgggcaaccagctgctgggccaggaccgcctgctgaccggccccgaggccggactgacccgcgacgccatcgccgtggaatgggagcaccggggccgccgcatgaagctggtggacaccgctggcctgcgcaagaaggcccagatctacgacgccatcgagaagctgtctgtgggcaacaccatcgagaccatccgcatgtccgaggtggtggtgctggtgatggacgccgccgccattctggataagcaggacctgaccatcgcccgtctggtggtggaggaaggccgcgccctggttctggccatcaacaagtgggatgtggtcgacgatccccagacggcgctgaagcgcctcaaggaccgtctcgaaacctcgctgccccaggccaggggcgtcgccacggtgacgttgtcggccctgaccggccgtggcatcgagaagttgatggatgcggtgctcgacacctggaccaagtggaaccgccgcattcccaccgcccagcttaaccgctggctggaagacatgatcgaacgccatccgccgccggccctgcccggcgggcggcgctacaagatccgctacatgacccaggccaaggcccggccgccgaccttcgtgctgttcgccacccggccggagcagttgccggaatcctattcccgctatctggtcaacggattgcgcgaggctttcgacctgcctggcgtgcctgtccgcctctatgtgcgcggcggcaagaatccctatgcagaaaaggacggctgaggcctgagtgctcctcaggcactccgggagtctgtctgtagggaaagcgctgctttttcagcggggaagcgccgcagaactccctttcgggggcttttgcccccgatcccccaaccgggaagcgcagcttcccggacccttcagtttttattttatcggaatgaaagaactggtggctcggaggctgtgcctccgaacaggtctgggcggtagcccagccgcgaagcggggctttgcgccagccctcattccgccgtcgcggccatctccacccgattgcggccgccgtgcttggcggcatagagcgcccggtcggcacggccgagaatgtcctccaccgagccgtcgccgagctggatggccgccactccgatgctgacggtgaagcggaccggctgtccctggtcatcgagggcggaggtgatggcctcgaccgcttcccgcagccgctcggccatgatggcggcgccctccagatcggtctcgggcagcacggcggcgaattcctcgccacccaggcgccccgccgtgtcctgctcgcgggccgaggcggccatggcggcggcaagcacctgtatcacgcggtcgccggtgggatggccccaggtgtcgttgatggccttgaaatggtcgatgtccaccatgaacagcgccagcgcgccgccatagcgcaaggtgcgggccagttcgtgctcggccaccgacatcagatgccggcggttgggcacgccggtcaatggatcggtgtccgcctgccggcgcaattcctcgcgctggcgcacggtggtcagataggagcgcaggccaagggtcgccagggccaccagcaacaagaacccggcggcaagctgtccggcccgcttgctccattccgtcaggattccggccaggtcgtagccgaccatgagaatcagtggaatgttttcgagcttgctcagcccgaagatccgctcgcggccatccagtggcgacacggcgacgaacgacgcgctggagcgctgctcgccgaagctgggctggccggtgggctgcggcgtgcgggttccgatgacggcgggcagttcgggattgcgggccagcagaacgccgtccccgtcgacgatggccagcacgtcgcgatcctcgacggtgaacgaggagatccagtcctgggcatggctgaggtcgatggccgccagggcgcctcccagcagcttgccgtcggcggacagcagatggcgcgacaccaggatcaccggccgccggctggccgatttctccgccggcacgtattggatataggtcttgtccgtcagtgcctccgggcgctcggcacaggacttctgattgctgcgaaagcccagcaggcgggtgtcggccgccgccacgaagacgcagtcggagttgtagatcgaaatgccggtcagccgcggcacgctggcggtcttttccgccagcatgccgttcagttgccggccccgctcggggtcgaggcgagggcgcagcacttccggtcccgtctggccgatcacgtcgcgcaggacgtaatccaccgagatgatggtggtcccgaaccattgcgccatgaactggctcttctggaccgccagcaccgtccgctcggcgacgatgcggccccgtccctcggccaggtcgacgcccagccaggccgcaacccccgccaggatggcgaacagcgcggaatagaggatggccggggactgggacacgcgccggcttgatctcgccccttttcgactcactccggaattctctcccttagatcgcgcaaaaccgcgagggccgaagtgtacacacccttcgcggcaattgcatggagtggctttgacgcggtgggatcgtggctggcctcgccgggggcgtcacttgtgcttggagaacaggtccagcgtcttgcacagcagggcgccgatgggacgcggcttgggggccgacaggcactcggccaggtaatcggccaccgccttgtccgggtcggtctccgccgtctggcgggcgtcgacgccccgggcctgcatgcgcttcatgaaaccctcgcccgccgaaatggcgatcacggtggtgatgccgtccagcggatggggggcgtcgccctcgtagtgatgaaagacctgggcggcttccagttcgacccgcacggcagacgaagcggtgttcggctcatagaccagccagtggcgggcccggccggcatggcctgataccttgctgtagcgggaatccacggcgacggcgattttcatggtgagttgtccctaatgtgacgtacttcatagacacggcaatatcggtcgatcactacagcgattctgggggcttaatacgcatattcttgcgcattcccttgatgtggggcctgaactcggcgattatccggcaggcggaggagaacgactgtgacggtacgcattctgatagccgaggatcaacaactggttcgtcagggcctggttgctcttctggcggttgacgatgttaccatcgtcggagaggccgaggacggcaagggcgccatcgaaatggcgcggacattggcgcccgacgtggtgctgatggacctgtccatgcccgagctggacggtgtcgaggcgacgcggcgcatcaagcaggtggcgccccaggtgcgcgttctggtcctgaccgtggccaattgcgagcgccgggtggctgaagccctggccgccggtgccgacggttacgccctgaagaagctgggccatggcgaattgatggccgccatcaacgcggtctgcgccggcaagacctatcttggtcccggcctgtccgaagacctggtcaaggaatacctggaaggctcggacatgggcggcggctcgctcaccgcgcgcgagcgggaagtgctgcagctgatcgcccgcggccacaagaaccgtgagatcgccgacgaactgggcatcgccatcaagacggtggagacccaccgcaccaagatcatgcagaagctggacctgcataactccgccgaactggcggcctatgccatccgccgcgggctgatcgaatagtcaggcaatggcgcgggtcacccaggcccgcagcctgccggtcgcccggcgggcgaagcgccacagcctccagccgttcagccgcgcatgggcccaggccttgacgccgttgatccagtcgtgcaggcgcacgaaccacgctaccgtcatcaaagtcggcttgcacagagtgtagatgcgggcgaacagggcggtggccgtcagcttggcggtcagcagcaccagcaatccccacagcacatgcccctgggtgatggcccacagcgccatcagcttgaagggaaacatgacggcgccgggggccaggaacagggcggcggcgcccaagggcggcaaggcctggatgcgggcctccaggcgggcgaccagcggcaggcggccgagacgggccatcagcgccttcaggcccgcccagatgacttcttccagcagcagcagaatcaccgctggcgggaccagcagggcggagacgaggggatgacggcgcgatggctcggacacgggcatggaactccgccgggggttggcgttcggtggactgcgccgcatcaatataagacgcggcggctgtcacgcaaacgtcaggctgggctgctaggttgcggagcccaaacacttgtgaaagcccgccatgcgcctcccgtcctcgccgctcggaatctttctggtcatttgcgccgtcctgctgcccaccggggccgggctgaccgcgccggtctggctgatggtcatgggcgtccgcctcgatctggccgcgtccatcggttcgcgcatcgtgggggtgaccgtcctggcctgcgccgctctcgccctggtctatcgtctggtgctgcggcccaggctgcaggcccatcccatcgccgcgccggtgatggcggcggacggcccggccgaggacaattcggcccgcgaccgtgtggttcacgccctggtgtggtgcctgttcctggtcccgttcgtactgctcgtggtgggattcatcgtgggtcagctggacgcggcgaccggggtggactgacggcgtccgctgacggcttcttacgttttctctgccgggtgccgcaatccaggcataattgagcccgagcccggcggcaccggtccttcaccgggcaattctcgggcggctcggtccgggtggcgccgccggattgtgggtcggcgggcgtggaggagggcggagtgtccatggcgcctaatgcccgcccttcttttccttcttctcatccttggcctctttagcgtccttgccgccacccttgcccacctgatcggggcgcatgaagacctgcatgggtttcagccattcggccgcgtcattggcacgttcggcaacggcggcgcggccgtcgcttgatgcgttgagcgtggcgctgaccccttccaggcaggcccgctgcgccgcctcgtcgccaccctcggcgcggacggcgaagacggcccgaaccggaatggcggcatcggggccgttggggcgaagcgacagcatccagccgaccttgcggttggcgccttcgatcaccccttccttcatcatcagggtctggttggcggccatgatgccgatggaatagcgcaggaccatgccgtcgggcggggcaaccagggtcacgcccaccggaatgggcttgttgccgtgcagggccagttctccctcgacggcataggcgatgccatcggcgtggggaaagcgggccagttcgttcttgaaggaaaaggtggcctcgttggagcgggtccagccacgagggatctccttgcgcagcaaaaaacgctctaccgtgcggcgcagggtgtagaagtgttcgtcctcggcgggcgtgaagctctcgcgtttgcgcggggccggcagcaggctggtggcctcgatggtgaagatgccgaacccattggccaccggcgcccgttccaccagggcaaagctctccaccgccaccggggtgaccaggggggcgccggcgattcccttgaccggagcggtcgccgcctgggattccgccgcttcggcgctgttggtcaggcagagtcccgccagaatcgccactgtcgccatcggccagagctgcattggggaagtccgttcctgtgcgtccatggtgaaaggcggcattgtgatccctgttcggcggggttttcaactcccagatagggagaggggatggatattgaaaggtcagggatgatggaggaacaagtcggcccggtgaccgtcagcatcgcgcgcagggcgattcccggccgcgaggccgattacgaggactggatctcgcgggttaccgccgaggtctgtcactggccgggctatcagggcgtcagcgtcctgcggccggtggccgccaccgactacgcctacgtcaccatctaccgcttttccacctgggagcaatgccacgccttcgaaaagtccgaggagcgcggccggctgctgcgggaactggacggcatggtcgagagcgaaggggagatcaagaaggtcaccggcctggaattctggttcgacctgccggaagtccccgcccaggcccgcccgtccccccataagatggctctggtggtgactttggtggcttacggcgtggtcatgggactgaccttcaccatcggcccccagatctccggcctgcccgtctggctgcgcgccctgatcatggttaccgcccaggtgacgctgatgacctacgtgttcatgccccaggccacccggctgctgcgcccctggctgttcgggcgctagggcatcgagcgccaaatatgacgcacgatggtctaggggcagtcgacattcagggaactcggctgatttcggaccagagcgagttcctggcaggaatttcagccacagatgaacacagataaacacaggtgaattcggaaaaattcttatctgtgtcccgcgcggcgggaatctgtgttcatctgtggcctatttcttgacctatcaacttgaatgtcgattggtcctaaggttcgtgttgtccctcggcctcagcgcggcatggcgccgggcagggcgaagcgggccagggccaccgattgggcgggaaggttcacctcgtcggcgaaggccagcagcgacgcctcgtcatccagcaggaaatccaggacggcccccaggatttcggcctcgccggcgcggcggcgcagggtgtcgctgtcacagccggtcgccgtcaggaatcgcgtggcccgatcctggtcggtcaccacccaggccagagcgcgcaaggcagtcacttcggcggaatttggggacatcctggcgtcacgcacgacccattcccttctcccggttcagccgttcgacccgattgagcagcagcatggcgcgatcggcggcgggccaatcgccgcggcgagccagttcggcggcccgacgggcggcaaccgccacggcttcccgtccaaaataggcgaccatctcgtcggccgcgcaggtccagtgcttttccattggcgcctccatgagaacaaaaggctaaaatagtgcgaacaaaaaggcaatacacaaaatgtgtggtcgctagttggggttgacggcacaatctttgatgcccatctgaccggagcgttggtaatggggctttggtatgcggtggaggggctgatgcgactgcgctggaccatggccttggtggtggcaaccgcacttcttgccgtgttcatcctgttgcgctggggcggagttttcgatgaccgcaaggtggtggtcggtgtgctcaatcacgccatcgtcgcggaggaggccctggacggcttcaaggctggactgggcgggctcggctggcccgagggcgggcgcgtcacctatcactaccgggggccgctggccggtgccgccttggatgccgaggccgaacgtctggcggaactgaaaccggacctgttcctgaccctgtcgaccccggcggccaaatcggcgttcaaggtggcgaagaacgcgggcattcccctgatcttcgcgccggccagcgatcccatcgccatcggtctggcggaaaatctggggcggcccggacggaatgccaccggcgtgaccttcggcatacaagagcctgtccggctgcaatggctgaagaccatgctgccggatctgaaagcgatcctggtaccctataatcccgatgatttgtcgccgctggcatcgctgctgaaaatcacgccgcttgccggagagctgggaattcgcctggatcacgcccatgtgcgcaacggggcggagctggacgcggcgctgtcggccatggcgtccgacgtgggagcggtcttcgtgccggtggatgcctatgtggcgtcgcaggtgccccgcatcatgctggccaccctgaagcggggcatccccctcagcacgccgcagcgccgtggcgtgcaggaaggtgccttcatgtcgtatggcctggatatgcatgcgctgggcgcccagggtgcccgcctcgccgcccaggtgctggggggcgtgccggccggcgatctgccggtggaaacggcggaattccggctgaccatcaacatggacacggcgggtcgcctggggatctcgctccccgacccgattttgcggcaggcggacctgatccgtatctcgagggatgccgatggacgctgaccactccctgcaccgcaagcttcgcctggccttcctggggctggccctggggccgttgctggtggcggggctggcgttgtcggtgggggcctaccggctgcaggaccgtcagaccgaggccatccagcgtcaggtcggccggaccatcgtgtccgagttccacaattacctgggaatcctgattctcgaactggaagagccgttgcggcgccgggggatggcggggcttgaggcggacgggttccagtccctggccgacgggctggtggccttcgagcccatgttcatcgaagtggccgtgctcgacgctcagggtggcgtgctggcgcgggccagccgcttcgagccggtcatcgcgcggggatcggccgggatcgccgcgctgcccgaagtgacggcggccgtgatcggccagaccgccgccattggagggatccgtcattacggccccaccaacgagccgatgatcggcctggccgtgccttcggtggaccccaggacggggcgccccgagggggtgatcctggcccaggcccgctttcggcgagtctgggacctgacccagccgctgccgggcttgccgcaactgaacagctatattctcgaccacgccggccaagtgatcgcccaccggaatccctcggtggttctggctcggaccgtacggcccatgcccgagaccgatggcttcggacgggggctgggaagcgactgggtgttcagcaccagcgaatccttcgtgatcggcgggcgccgcttcgtggtcgtggtcgagcagccgctgctcagcgccctcaagctgccggggggagcggtggtcatcgttaccctggtcctgctgttcggcggcgtgggcgcctgggtcctggtgcggtactcgcgccgcgccattctggcgcccatcgatgcgctggccgaggcggtgcgcgacgtggaggccggcgacatgtcccgccgcgctccggtggaatcgtccgatgagatcggcgccctggccatggccttcaattccatgaccgggcgggtggccggattgctgaacgacctgggcgaatccgaggaaaaattccgtctggtgatggaaagcgccagcgatgccctggtggtgatcgatgccgagggcaagatcgtctcctggaacggcgccgctacccgcatgttcggctatcagccggccgagatcatggggcgcaatgtcagtcttctgatgcccgagcacctgcgggagcgtcacgatcagattctggcccgcctccgcgccaagatcgatgcccggatcaggacggacccgcgtgaacagccggccatgcgccaggacggcaccctttttccggtggaagtgaccctggccggcttctcgttcaagggcaaccgcttctattccggcatcatgcgcgacatctcggcgcgcaaggaggcggaatccaatatccgtttcctggcccgccacgacgccctgaccggcctggccaaccgggtggtgctgcgcgagaggctcgacgagatcctgcctcagaccggggcgcggcagatgcattgtctgctgttcatcgacctggataacttcaagctagtcaatgacgtcctggggcacagcttcggggaccggctgctggtcgaggtggcgggacgcctgcgctccatcgagggcggacacaacatcgtctgccgtcacggcggtgacgagttcatcctgctggctccggacatccggacccgggaacgggcggcggaactggccgagcgggtcctggcggtgatgggcgatgccttcgccatcgatgcccaggccatcgaggtgggatgctccatcggcatcagcgtggcgcccgatgacgggaccgacgccgagaccctgatccgcaaggccgacatcgccatgtacaaggccaaggagaagggccgcctgggctaccagttctttaccgccgccatggaccaccagatggtcgagcgccgcgagctggagaagagcctgcgccggggattgcgcgacggcgagatcttcatccacctgcagcccaaggtccggctgggtgatggcggcgtcaccgggttcgaggcgctggcccgctggcaaagcgccgagcatggcctggttccgcccgtccgcttcattcccttggccgaggaatgcggtctggtcggcgccatcggcgacgtggtgttgcgccggacgctggagactctggccggctggcgggcggcgggtcgcaaggtcctgcccgtggcggtcaacctgtcggccgtccagttgggcaatcccgccctggcgggcgagatcggcgccctgttgcgtgagttcgacctgccgccctcgctgctggaactggaactgaccgaaagcatgctgatgggcgacgtggatcaggtccgcgccattctgttccgcctcaaggaccaggggatcaggctcagtatcgacgatttcggcacgggttattccagcctcagctatctgaagcgctttcccgtggacgtgctgaagattgaccggtccttcgtcaccgacctgcccggcgaccccgagggagaggccctctgcctggccatcatccacatggccaaggccctctccctcgacgtgatcgccgaaggggtggaaaccgaggcgcagtccctgttcctggcgcggcacggctgcgactatgcccaaggcttccacttcgcccgcccggtcccggtggacgaagcggcggagtatctgccggacgcccgtgtttccgaccggacggtgtgaggggggcggggcggcgctcagccgctggacagttccatttccgccagcagccagtgctcgagatcctggccatggggacggccgcgggcttcccagatggcataggcccgttcgcgcaggcgggtcatgtcgtcgccatgggccaggatgtccgagacctcccggttgatgtcgatcaaggtgttgacgcgttcgtcattggcgccgttgccgtgctcgtccgtcgacagggcataggccacctgccgctggctggggaactgccaggcccgcgcggcggcgatgtgggccagcgtgcgccaaacccgctggttgcgctccagcgccttgaggaagctggccgtgtcgcaggccctgtccagttcctgcgccgcctcgtcgagagccagggcgccggtctccgccaaggtcagcttctcagggttcagacttgccatcgggtccctcccgactgccgaattatacaatttcgaggataatcctagggcgaatggcatggggattcaatgccgcttaagtgatgttgggatgacactttcggcactgacatatatcaaagccagccggtccgccccctggtacccttgacctgcatcaaccggtgttttccgagggggaggactgagatggttatcgatgacacggccgttatcgccttggcgtttctgggattcattctggcggtgaccggcgggctggcctggttcgtgctgagccgcaagtaaacggttccgaaggggcggccgccgggcgttcagccggcggcctgccttttcagttcgttcagcacgaagactcggatggccgacgacaggttggcctcgcgcgtgctgtcgatcccggccaccatctggttgatggatgtgccgcggctttcggccaactccctgaggcagtcccagaattccgcctccagcgtgacgctggtggcgtggccggcgatcttgaccgagcgcttgaccggctgaccggtcacagctcgccccgggccgactgggccggcgcgccctcccactgggaatgggccggcaatccttcgcccttcatgatgatggtcagcttgcccacccgggcgaagtcgcccacatcggtgtcgtaaagcacggtcgagcccgagcccacggtcacgccggtgcccagcttgacgcggcccaccttcatgacccggtcctcgtaaaggtgggtctgcagcgccgacagcgagttgatggcgcagaaatcccccacatcgatgcagtcgaattcggtgatgtccgtggtgtccatgaacacgccggagccgaagcggcagccgtacagccacaggaaccagggcaggaacggcgtgccgcgcagatggtccagcagcaccttgcccgccaggccccaatacatcaccgccaccgcctcggtgcgcagcgcccaccatgaccacatgggcttggcggtgggacggtagacgcccatcatcagccacttcaccgccaccgacgacagggccagcgagaacgagatggccaccgacgcggccacgaacagcggcaggacgatggcgtaatcccgggccaggatgctgggcgccagcagatccacggtcatgatgccgaaggtgatgaacaaagcggtgggcagcgagacggcgaaggcctcgaacacggcgcgccacacccggcgccacaggggcggcgcgaaggtccagtcggcgcccacgtcgtcgaagcgctggcgcaccggcagcttgaaggggggattgccgaaccaggtatcgcccggcgacatctgctcgttggccggcggccgcgacttgatgccgatcagggcgccggtgggaatcaccgcgccgggcggcaccacggcgtcgttgccgacgaagacgcgggcctcggtcttcacgggctccagcaccatccagccccggcgcacgcattcgtcgcccagcaccacctcgtcggcgatgaagcagcccggcccgatatcggtcaggtcgtagcgtccggccagattgcacgagatttcggcgtccttgccgatcttggcgcccatcagccggtaccacagccgcatatagacggtggcgtagagcgacgacagggtctcgagcatcagctcggtggccagggcgacgatccatttgcggacatagaagccgccatagatggaatagctgcccgcggtgaccaccggcagcaccgaccagcgcaccacggcgatcagcagcacggtgacggcgatcagcgccatggcggtgggccaggccagcagcggcaggatggtggcgtattcgccgccggcgaaatagtcgctgaggcgctcgaagatgaagaaggccgggaagatcggcagcaggctgatgggcggcagcactaccagcatcaggccgtagaggcaggtcagggccagcttgcggccgaagccggcatgggcggcctcgggcagggcggcctcgtcgaccatgcccaccttgcggccgggcgagccgtcccaatgctcgtagcggccgatgcgggtgccggcggcgatggaggtgaggtcgccgacctcgccgcccgtctcgatcaccactccgtcgctgagcatgcacgaggtgccgatataggcatcgtcgccgatcacgatggggccgatcaccagttcgtcgcccacggcttccgcattggccagccgggtcttgccgccgatggccacgccgttgccgatggtcaccagatcgaaggcgccggcctccatctcggccagcacgcagtcgctgcccaccctggcgcccagcaggcgcagatagatgctcatgatcggcgtgccctggaaccacttgatatgggcgacgctgaccacgcgctgggccagccaccagcggaagtaatagggtccccacagcttgtggcggccgggcttggtccgccccaggatcacccatttgagggcgatggaggccgagatggtgcccacattgatcaccgcataggtgagcatcagggtgctcatctcggtgaagaagctggcatcctcgcccgacagcagcatgtaggagatgaacacgcccagccacggcgccgtggtcagcgccaggatgaagggcatggccaccgcctgggccagtccgcacaggaagcggcggcgcagggtgggcggatcgaaggacaggtcggcgggcttggccccggcggccggggcgcgcaggtcgagcagcgctcccatggcccggagcgtgcgggcggaatagatctcgttgagcgtcaggctggccagttccggcgtctcgcgcaccgccgagacgaacttggcggccagcagcgaatggccgccgagatcgaggaagaaatcggcctcgaaggcaatgacctgaccggggaacacccggcgcgccgcctccagcagggcggcctcggtggtggtcgccggctcctcctgctcgccgccgccgacggaaaggtccagcggcaggtccttcagcgccttgcggttcagcttgccggaaatcaggcggggaagctcgtcgaccaccagataatgggagggaaccatataggcgggaagctgggcgcgcaggccctccttcaacgcgccgccctcgatgacggctccggcctcgggcaggatggtcgctaccagccgctcgatgccgtcgtcggtgcgcaagctgaccgccgcctgattgacgccgggaagcgccgccaggcgggcttcgatctcgcccagctcgacgcggaagccgcggatcttgacctgatcgtcgatgcggccgtggaaggtgatgtcgccgttgccgtcaatggccaccgcgtcgcccgagcggtacagcaccggggcgctgccgtcggtgtcccagggattggggatgaacttctcggcggtgaggtcggggcggccgagatagcccgccgccacgcccggcccgccgatcagcagttcgccggtggcgccgggggccaccggctggatgaaatcgtccaccacatggcagacatagttggggatgggccgcccgatggtcaccggcttgcccggctcgacctcggccatggtggcgaccacggtggcctcggtggggccgtaggaattgaagatgcgccgtccgggccggcaccagcgctcggccagggccgcggggcaggcctcgccgcccaggatgatgacccgcaggccgggaatgtcgccgggcagcaggctcagcagggtcggcacggtgtccagcacggtgatgccggcctcggccagcacctgcggcaggcggtcggcctcggccaggtgcgccggccggcgatccacagcttggcgcccaccagataggggacgaagatctcctccagcgacaggtcgaaggccaccgaggcgccctggaacaccacgtcgtcggagcgcaggccgtaaagggaattggcggcgcgcaggtagtggcagatgttgaaatggctgatgacgatggccttgggcttgccggtggagcccgaggtgtagatggcataggccgggtcggccggattggcgccctgggcgcgcgggtcgggcgaggcgccgccgggggcgccctgctccagggtcggcagaatcagggtatgggccggcatggcgccggtgatggcgcccatggtgaaggcgtcgacgatcagcgccttggcggcgcaatcatccaggcattcggcgacgcgctcggcgggggcttcggtgtcgaaggggatataggcggcgccggcggccaggatgcccagcagcgccacatgcagatccagcgaccggctcatccacaggccgacgaaatcgccgcgtccgatgccgcgcgccgccagggcacgggccacggcctgggcgcgctccgccagctgggcataggtcaaggtggtgtcgccgaaggtggcggcggcggcgctggggaaggtcctggcgctggtggagaagatctcccacagggtctcgtcacggatcagcgaggaatcgcgggccccgaacagggcggaaggcagggattgtgtcacgtcatttccaggttgggcgcggcttcggcgcgcgcggcgatggccaaggcctcgtccatggggagggtataccaactcacggcaaagcggtcaccccccacgttgacttttgtgctgatccaggggggcgaatcggccagatcccgcaggaacgacaggtccggttcggccaggccgtcgacgatgccggtgcccctggccttcagcaccgcctccttggcggtccacagccgggcgaaggccaggggccgccgggcggcgggcagggcggccagcagcgcccgctcggccggggcgaagccttgcgaggcgtcctcccatacggggatgcagcgctccagcgtctccacgtcagcccccactggcccctggcgcgagccggcgatcagcagcaatccgtcgcaggacgcgcagttgaaccagtagcccgaatccggatcggccagcatgggcttgccgaaggaatcgcgggccaggacgatttcggcctcggggcggtccaaccggcgggccagatggcggacaagcacccgtgaccgcgcctccgccgcctgggcgatgccggtgtaaagccaggtcatcccatccaatggtactgtgtctaatcgcatcgactctgccgtcccaatgcggcattctggtgggcggtttcctcggggtggatggtcagaatggcgcgtgaaccagagatcgtcacccgttatcgttccctggccctggaaaacgatccggtcgcccagttcaagctcggcgatctctatcgcctgggctatcaggtcaagcgcgacctggacgaggcggtggtctggctggtgcgctcggcgcgccagggcaacgccgacgccatggccttgctgaagaagatggcggccgacggagtggatgtgcgccgccgggtcgacgacctgcccggcaagtggcaggccgctccgcgtcccgattacggcgctccgccggccgaggcccccaggccgccggccgccgagcccgaaccggctcccccgcctccccagccggtagaggccgagctcaagcccaaggtcattcccctgcccgagattgaggtggagaccgaccccctgcgcatcggcgagaccatcgacgatccggtcgccttgcgcgccgccgtggacaagggcgatctggccgccatggtggcgctgggcaatgcctaccgcgagggcaagggcgtagccgtcgacccggccgaggcggtgcggctttacacactggcggccaaggccggcgatgcccgcggccagtattcgctgggcgtgatgtacgacctgggcctgggcgtggcgcaaagcaacgcccatgcgctgaaatggttccgtgaggccgccaagcagggcgacccgcaagcccagttcaatctgggcaacatgatccagcaggggcgcggcgtcgaatccagcgcggaagtggcggccaaatggttcaagcaggcggccgagcagggcgatgccggggccatcttcgccctgggagccctctacgaggcgggaaccggggtcgagcgggacgagattcaggcggtggagctgtaccgtcaggccgccgaccagggcctggccctggcgcttcacaacctggccaacatgctgcgccaggggcgcggcaccgatgccgatcccttcgaggcggccatgctgtgccgccgcgccgccgagcaggggctgcccgaagcccagtacaattacgccgccatgctggccctgggcctgggggtggaaaagaatgaggacgcggccatccgctggttccgccgcgccgccaaatcgggcgacccgcgtggcgaggcgcaggccgaggcgctggagaaacggcgccgggcggaggccccgtcatgagcggctccaagacctcctacgaggtccaggtcctggccgacaagaactgggtgatcgccgaaatggcgccggacgaggccaaggccaaggccttcgccgagaacctgctgcaggcgggtaaccacgcggcagtgcgggtggtcaaggatttcgagcgcatcgacggcacccattccgagaccgtcatcatggagaagaaggctgccgagaaggcggccggcgatccccagctcaccaccatcaccgaggcgccgccctgttccgagctggaggatttctaccgccagccggcccgcaccacaatgggcaaactgctgcgcaaatacctggacgaggcgctggtgacgccgttcgaattgctgcacgacgccaaggagatgaagcgcttcggcgacaagggcaacctgctgttctcggccatcgaccgggtggcggggctgcaggccaaggcttcgggggaagagtccaaggcgcgcaaggatttcctcgacaagacctgggaggagatgggcaagcgtgcccgcgacttcgccgccaagaagcccaaggcgccccagaccttcgccgaggcggtggccgcgtccaagggcgattgctacgcgctgcgctccttcatgaccctggcgctgttggagaagcgctcgtggttcggcaagctggacctgctgatcgcctggtcggccgaggaggccgccaagggcaacatggtggagatcgacgcggtgatcgccgatctcaccgtgcccgcccaggtgattcaggacctgctgggcttccagtccaacctggcggcggcgctgtgcaccatcgtcagcctgaccgaaggcggcgccgaggccgccaagttcgccccccagaccttcaccgagctgaacaagctgttcgcggaaggctcgctgccccaaagccgcgaggtgctgatgggccgggtggtgcgcgaggcggggggcaccaatcccctgtcgcgcaacgattcctcccaggaatacgagatgttccacaagctgatgatccggctggtggacaaggatcgggtggtgggcggctcgcccatggccgaggcgctgctgcaacgcggcgcccgggtgctcaattccggcggcgcctcggtttccgccccccaggcgctggaactgctgctgggcgccctgcccgacggctgcgtgcggctgcagttcctcctcaccctggcgggctccagcctgggcaagagcatgggcgagatcctgaccgagatgctcgacgcccatgtgcggcgggccaaccatatcgatgcctgggtgccggtgcgtctggcgcccccggcccgcatggcggcgctgaacaacgccaacaagctgctgcgcacctgtcccaatctggtggaggcgttccgcaaggagctggccgaccgcatcgacgacgtgatggtgcgctatctcacagccgaagagatcatcgagaaggtggacaagcccgacgaccccctggccatgcgcgccatccggctggtcaagttctgcggctcgggcgtgctgatcgagggcaagtccctgaacatggccaaggcccgcgtggtcgagcatctgcgccagaagcacttcgaggagaagttcgtcgcctccatgcccgatcccacccagggcgagaagcatctgcgcgacttccaccgcctgctggtggaatgcggattcggctgaggccgtctccatcccaagcgtcatcccgaggcccctggccgagggatctccgtttggcgttctgtttcctgttgggaaaagccggttcaggatgagatccctcgccaaggctcgggatgacacggcgagtctccgcggcccctccaaagaatcactggcgatgcattgcacaatcgttgtaactacctgccgtcggccgcgcgatcccgcccggtcgcgatgaggcgtggggaaatggctggacctgttctcgtcaccggggcgaccggatttgtcggtgccgccatcgtccgtgccctgctggcgcggggcgaggccgtgcgcgtgctggcgcgccccgcttcggaccggcgcaatgtcgccaatctgcatgtggaggtggccgagggccgcctggaagacgccgcctcgctgcgcaaggccatggccggctgccgggtgctgatccacaccgccgcagactatcgcatctgggtgcccgatccggccgccatgatgaaggccaacgtcgagggcacgcggacgctgatggaggccgccctggccgagaaggtggagcgcgtggtctacacctcgtcggtggcgacgctgggccatgtggaaggcggcgtggccgacgaggacacccccagcgacatttccgacaaggtaggcccctacaagcagtccaagttcctggccgaggaagtggtgcgccgcatggtggccgaacagggcctgccggcggtgatctgcagcccctcgacccccatcggccccggcgacgtcaagcccactcccaccgggcgcatgatcgtcgaggccgcctcgggccgcatgccggcctatgtggataccggcctcaacatcgtccacgtggacgatgtggccgcgggccatctgctggccctggacaagggccgcatcggcgagcgctacatcctgggcggcgagaatctgaccctggccgacatcctgaaccgcatcgccaagatcaccggcgggcgtccgccgctgatgaagctgccgcgctggccgctctatccgctggccctgggcgccgagacctgggcccgcttcttcggcggcgagcccttcgtcaccgtggacgggctcaagatgtcgcgctggcacatgttcttctcctcggccaaggccgagcgggaattggggtaccgccaccgtcccgccgacgaggcgctggacgcggcggtggagtggttcaagagcatcggggaggttccatgagtctggcatcgcttgccggtctggccggggcaggggcctgggcctggctgttgaccatgcgcggatcgttctggcggatcgaggatgcgccccaggccgtggtgcccgaggcctggccccaggtggtggcggtcattcccgcccgcgatgaggccgacgtcatcggcgccaccatcgagtccctcctggcccagaactatcccggccagttttccgtggtgctggtggacgaccattccacggacggcaccgccgaggcggcccgccgggcggccgaggagatggggctggcctcccgggtgattgtggtcgaggcgccggagctgccgcgcggctggaccggcaagatgtgggcgcaaagccatggcgtggcggtggcccgcgccaagttccccgaggcggagctgctgctgctgtccgacgccgatatccgccatggaccgggcgaattgcgccgcaccgtgtcgcgcatgctggccgaggggctggacatggcctcgctgatggtgcgcctgtccacccaaagcctgtgggaaaaggccgtcgttcccgccttcgtgttcttcttccgcatgctctatcccttcgcctgggtgaaggattcgcgttccaccacggccgccgccgccggcggctatgtgctgatccgccccgtcatgctggagaagatcggcggcatcaaggccatcaaggacgcgctgatcgacgattgcaccctggccgccgcggtcaaggcccatcacggccgcctgaccctcgacctggccgaggaaaccatcagcacgaggcgctacgaggggccggaaggcctgtggcggatgatcgcccgctcggcctatacccagctgcgccactcccccctgctgctgatcggcacggtgctggccatgctgctggtgttcgtggcgccgcccctgctggccatgcgtaacggcggcggcgcgtcgaccggcgccctggcctgggcggccatgaccatcgcctattaccccatggtgcgctattaccgcctgtggccgttctgggccctggccctgcctctggtgtcgctgttctacctgggtgccacgctgcattccgcctggatgtattacggcggtaagggcggcgaatggaaagggcgggtgcaggatacccacggccaggggaaagcgtcttgaacgccatgaccccctccgtcctggccatcgacccggcccagtacgacatggtggcggagatcgtgcgcgcctcggggtcgtcgttctattggggcatgcgcctgctggaccggccgcgccgctatgccatgtacgccatctacgccttctgccgggtggtggacgacatcgccgacgagccgggtgatcccgaggttaaacgggcgcaactagccgaatggcgagtcgaactggaccggctttatgcgggagctcccacccatgccgtcgccaaggcgctgcatgggcctgtcctacaatacaacctgcccaaggaagactttctggcggtgatcgccggctgcgagagcgatgcccagcccgaggtgacgcgcctttccatggccgagttggagctttactgcgatcgtgtcgcctgtgccgtgggccgtctgtcgattcgcgtgttcgggcccctacggcccaaatccatcgagacggccaacgcaacgggcatggcgttgcagttgaccaacatcctgcgcgacgtcgcggtggatgccaagatcgggcggctttatctgcccgacgaacttctgtccaagcacggcatcgccagccgcgatcccatggaggttctggcccatcccaatctggtggcggtgtgccgcgaactgggcgagacggcgcggggctatttcctggcctcggatgctgggcaggcagagtgcagcagggcagacatgcgcccggccaccttgatgaaggagatgtaccgcgagatcttcacgcgggtcgaagccgaaggtttcgtgccgcgtgatccgccggtcaaggtttcgaaagcgttcaagctgtggtgtattctgcgccacggtcttctttagagcatccgtatccgtagaggtccgacgtgtctcccagcgaaatcaatccccgtgacttctccgccgcctcgttccgcgatccgctggagcgtgcggtcaatgaatccgccgaagccctgctgaagcagcagcgcgaagacggccactgggtgttcaagcttgaagctgacgccaccatcccggccgaatacgtgctgtatctgcactacatggacgagcgcgatcccgagctggagaagcgcatcggcgtctatctgcgcgacatccaggaagagcacggcggctggccgctgttccatcgcggcgatctcaacatcagcgcctcggtgaaggcctatttcgcgctgaaggccatcggcgacgacatcgacgcgccgcacatggtgaaggcgcgcgaagccatcctggcccatggcggcgcggccacggccaatgtcttcacccgcaccctgctggcgctgttcgggcagatcccctggaagggcgtgccgatcatgcccgtggagatcatgctgctgccgcgctggttcccgttccacatggacaaggtcagctattggtcgcgtaccgtcatcgcgccgctgaccgtgctgatgaccaagcgccccaaggcgcgcaatcccctgggcatccatatccaggaactgttcgtcacgccgccggagaaggtcaccaactggtatctggaaccggtgcgctccaactgggcctatctgttccgcggcatcgacatggtgctgcagaaggtctaccgcttcttccccaagtcggtgcaggacaaggccatcgacaaggccgtggccttcgtggacgagcgcctgaacggcgaggacgggctgggcgccatcttcccggccatggtcaacgccgtatggatgtacgacgtcctgggcgtgcctgcggacgatccccgcgtgctcatcgccaagaaatccatccagaacctggtggtggaagaaggcgagcgcgcctgggtccagccctgcctgtcgcccatctgggacaccgccctggccacccacgccatcctcgaggtgggaacccccgaggccgacgcggcggcgcgcaaggccgccgattggatggtggcgcgccagatcaccgacgtggtgggcgactgggcggtgcgccgccccggcctcgcccccggcggctgggccttccagtacaacaatccccattaccccgatgtggacgacaccgccgtggtgatggccgcgctcgaccgcatcgacccggtgaagtacgccgagcccatcgagaagggcaaggtctgggtccaggcatgcagtcggaaggcggcggctggggggcgttcgacgccgagaacaccagctattacctcaatcatattcccttcgccgatcatggcgccctgctggacccgcccaccgccgacgtgtcggcccgctgcgtctcggtgctgtcggtgctgggcgagcgcggcaaggacaaggtggcgcacgaaggcgtcgactacctgctgcgcgagcaggaaaaggacggatcgtggttcggccgctggggcaccaactacgtctacggcacgtggtcctcgctctgcgccctcaatgccgccgggctgccccatgaccatcccgccttccggaaggcggtcaagtggctggaatccaagcagcgggacgacggcggctggggcgaatgcggccggtcctactgggacgaccagcccaggggcatgggcggcccctccacgccgtcccagaccgcctgggcggtgctgggcctcatggcggcgggcgagaccaagtcggccgccgtggccaagggcatcgactacctgatccgcacccgcaacgccgaaggcctgtgggacgaggagcattacactgcggtgggcttcccccgcgtgttctatctgcgctaccacggctatcgccagttcttcccggtctgggccctggcccgttatcggaacctgaccaccggcaatgccgggccggtgatgcacgcgctgtagcagcgatctgatcgggctgtcgcccgaacccacttgctcgccgggctcgcgtccctgcgggaccgcaccttcggtgcgtcgtttgccccttgcggggctgcacggggcgacgccccaaacccccttctgattcatgaatcaaagggaggtttggaggcatcgcctccaagcggggccggggcggcagccccgtttattggggggagcaccatgacaatcgccgtcatcgtcggcatgaacagtgaggctgccctgctgccccccggcattccggtcggcgcggcgggcggcgtgacccggcgggtaacggaactggccgagcggctgctggccgagggcgccgaggggctgctgtccttcggcatcgccggcggccttgacccggcgctgacatccgggaatctggtggtgggactcagtgtgcagtgggagggcgagacctttgccgccgacgcggcctgggcttcgcgtctgctgaccgccatccccggtgcgcggcaaggcaccatcgcggcggtctcgcgcatcgcggcgacgccggaggccaagcaggctctgtatcagggcggtgctgccgtggtggacatggaaagcggcgccatggccaaggtttgcgcggcggcgggcaagcccttcgccgtgctgcgcgccgtggcggacccggcggcgcggggattgccccggtcggtgttcgtggggctggcgcccgacggctcggcgcggccctgggcggtcatgggggcgctgctgcgccgcccatgggaattgccagggctgatccgggtcggcctggacagccaggcggctctagctgccttgcgagacgcggtgaaggttgttggcccgaccctcggaatgtagcatttccaggttcttggccatcagctcgtcgtaattgttgatggccgggcgctggttgtccaacggcaggtcgggagcgaaggggccttcggtgcgggggccacgcagggccaccatggcggccttcagcgggttgctgatggtgtccatcacggcggtggcctcatagcccgaatggaccatgcaatcggcgcacttctcgtacttgccggtgccgtaggagtcccagtcggtctcgtccatcagctccttgtaggtcttggcatagccctcgcccagcaggtagcaggggcgctgccagccgaacacgttgcgggtcggatttccccacggcgtgcactgataagtctggttgccggccaggaagtccatgaacagggacgactgggtgaattcccacttcttgcccttgcccagacggaacagcttgcggaacagctccttggtggcgcggcggttgaggaagtgctcggtatcgggggcgcgctcgtaggcgtagccgggcgacagggtgatgccgccgacaccgatggacttggtgtagtcgaagaacttcgccatgcgctcggcatcggcgttgttgaacagggtgcagttgatgttgacctggaagccggcggccttggccgccttgatggccgagacggcctgatcgaaggtgccttcgcgcgacacggcgcggtcgtggtcctcgcggtcgccgtccagatggacggtccaggtgaaattcttgtgcggcttgaagctgtcgagcttcttttccagcagcagggcattggtgcagacgaagacgatcttgcccctggccagggcaccctcgacgatctggtcgatctcgcggtgcagcaggggctcgccgccggccatcaccaccacgggggccgggcactcgtcgatggaggccagggcatcggccacggaaatgcgggaattcaggatggcgtcgggatagtcgatcttgccgcagccgttgcaggtcaggttgcagcggaacaggggctccatcatcagcaccagcgggtaacgcttgttccccatgaggtgctgcttgacgatataggaaccgatcttgatggactggtggagaggaacggccacgggctgaactctgattttgcctcgacgcgcctcccgcttgggaagcgggcggatcatacaggccggacttggaaagtttcaacggtttaaggagtgtgggctttatgcggcagccccgcattacggctgtcatcccgaggccaagccgagggatctccgccaggatggccggttcctgttctgaaaagccgtgccaggacgagatccctcacttccgttcgggatgacagtcttcctctaagccgcgtcctcgttgtccagcgcatagccggcggcccgcacggtgcggatgatgtcggcctcggtgtcgcagttcagcgccttgcgcaggcggcggatgtgcacatccaccgtgcgcggctccacatagatgtcgggaccccacacggcgtcgagcagttcctcgcgcgagaacaccgttcccggatgctgcaggaagaattgcagcaggcggaactcggtggggccgagatggatggccttgccggcccgcaccacccggtgggaggccagatccatggagacgtcgccccagctgatctgtcccttctggctgaccggctgggcgcggcgcagcagggcgcggacgcgggccatcagttcgggcagcgagaacggcttggtcaggtagtcgtcggcgccggtgttcaggcctcggatcttgtcgccttcctcgccccgggcggtcagcatgatgatgggcagttcgcgggtggcgggcttgcggcggatctggcggcagatctcgatgcccgacagcgagggcagcatccagtccagcagcaccagatcgggcttgcgctcggccagcacggtcagcgcctcctcgccgtcggcggcctcggcgacgcggtagccttccttttccaggttgtagcgcagcatggtggccagcgccgcttcatcctcgacgaccaggacaagaggcttggaaggattggcggtctcgcgggcggtcattattcctgggctccgagggtcacgcccttgggccggttgcccttgggctgggtgccgagaatctggaagtgcagggtctcggcgatgttggtggcgtgatcgccgatgcgttccatgttcttggcgatgaacagcagatgggtcgatgcggtgatggtgccggaatcctcgttcatctgggcgatcaggtcacggaagacggtattataaagggaatctacctcctcgtcgcgctcccagacgcggatggccttgtccaggtccctgtccacataggcgtcgaggatgtccttcagcaaggcctgcaccaactcgcccaggcggaccacaccgatggtcttggcggtggcgggaagctggttgagcaccagggcgcgcttggccagattggcggcatagtcgccgacccgctcgatctcgcccgagatgttcagcgccgcgacgatgtggcgcaggtcgccggccatgggctggcgcagcgccagcaggcgcacggcgaagctgtccacctcggcgtccagttcgtcgatgcggtgatcgctgtccaccactttgtgggccagatcgtcgtcgcgccgggccagggattgcagcgccgatcccaactgggcctcggccagcccgcccatgcgggcgatcatgcccgacaggtgggccagttcgtcgtcgtaggatttgactgtgtgctcgctcaagtctgttcgtcccttaatcgccggggcctcttccgcctgtcaccctgagccgaaggcgaagggtctttcaggcgaaatgtgccgccgtcttaggctgaaggatgcttcgcgtcgctcagcatgacagtttcttccgttcctcagccgaacctgcccgtgatgtagccctgggtcagcggctccttgggattggtgaaaatctcctcggtgccgcccacttcgatcagcttgcccaggtggaagaaggcggtgcgctgggaaacgcgggccgcctgctgcatggaatgggtgacgatcacgatggtgtagttgtcgcgcagctcgtcgatcaactcctccaccttggcggtggcgatggggtccagtgccgagcacggctcgtccatcaggatcacttccggcgccacggcgatggcgcgggcgatgcacagtcgctgttgctgcccgcccgacaggccggtgcccgattccgacaggcggctttccacctcggccagcagaccggccttttccaggctgttcatgacgatctcgtccagctcggcctgatcgcgggccaggccgtggatgcgcggtccataggccacgttgtcgtagatggacttggggaaggggttgggcttctggaagaccatgccgacccgggcgcgcagctggaccacgtccagcgagcggtcatagacgtcgctgccgtccagggtcagcgagccggtgaccttggcgccgtccaccatgtcgttcatgcggttgatgcagcgcaggaaggtggacttgccgcagcccgacggcccgatcagggcggtgacctcgccggccgggatgtccaggtcgatgtcgtggagcgcttgcttctcgccgtaatggacgttgaggccgcgcgccgagatcttggaggtcccacggggaatgaactggttcatgatcgttctaccaccggcgttcgaatttgttgcggagccagatggccgccatgttcatggccaccaggaacagcagcagcaccatgatggccgccgaggtcttctcgacgaaggcccgctccgagctgccggcccacagatagatctgcaccggcagcacggccgaggggtccagcgggctcttggggatgtcgacgatgaaggccaccatgccgatcatcagcagcggcgccgtctcgcccagggcacgcgccatgccgaggatggtgccggtcagcatgcccggcatggccagcggcaggacgtgatgggcgacgatctgcagcggcgaggcgcccagcccggcggcggcctggcggatcgagggcggcaccgccttcagggcggcgcggccggcgatgatgatggtgggcaggcagatcagcgccagcaccagcccgcccgccaccggcgacgagcgcggcaggtggaagacgttgaggaacaccgccagacccagcagaccgaacaccaccgacggcacggcggccagattgttgatgttgacctcgatcaggtcggtccagcggttcttggcggcgaactcctccagatagacggcggtggccacccccagggggaagctgatcagcaaggtcaccgccagcgagaagaacgagccgaccacggcgccccaaatacccgcctgctccggcgcccgtgaatcgccgccggtgaagaactggaggttgaaggccttgcggatctgcccggcctgctccaactgggccagccagcccaattggcggtcattgagcacgttgccggcggcgccgacctcacgcggggcctggcccttgtagaccatgtccagcttgtccgaggcggtcagccacaaggtggtgcgggtgccgatcaccttggggtcggcggcgaccatgcgccgcatctgctcggcgcccatggtgctgaccagggcggagagatcgcgccgggcgctgcggtcgccgtcgggaaccagccgcgccgccaggccgttgcgcaccagggcgggatagtcggccgcgtccagcacgtcgggggcacgggtgccgtcgggatcgatcacctcggcgtcgaagctgacctccaccgcgatctgggtctggaggaaaccggtccagcccttggcgaccacggtgcccagcagcagcaccaggaatcccgccgaaatcaggatcgaggcaaggccgaggatgcggaagcgccgctcggcggcatagcgccggcccaggcgggccgccacggtttcggcggtgcgggccgccacggtgatctctgccatctcagtcatacttttcccgatacttctgaacgatatgcaaggcgatgacgttcaatcccaaggtgatgccgaacagcatcaggcccagggcgaaggccgccagggtcttggggctgtcgaactcggtatcgcccaccagcagggtgacgatctgcacggtgacggtggtcaccgcctccagcgggttggcggtcagcttggcggacaggccggcggccatgaccacgatcatggtctcgccgatggcccgcgataccgccagcagcacgccgccgacgatgccgggaagggcggcgggcaacaccacctggacgatggtctccgagcgggtggcgcccaggccgaaggcgccttcgcgcaaggactggggcacggcggtgatgacgtcgtccgaaagggacgagatcagcgggatcagggtgatgcccatgacgaagccggcggccagcgcgctttccgccgccacgttgaggccgagggcgccgccgacggcgcggatggccggggccaccgtcaccacggcgaagaagccgaacaccacggtgggaatgccggccaggatctccagcgccggcttggcgatggcgcggacgcgcggctgggcgtattccgacatgtagatggccgagaacaggcccagcggcagggcgaccaccatggagatggcgctgatcagcatggtgccggtcagcagcggcaccatgccgaaggctccggagctgcccacctggtccgagcgggtggacatctgggggctccagttcaggccgaacaggaagtcgacgaaatccaccatgtggaagaagcgcagcgcctcgaacagcagcgacagcacgatgcccaccgtggtgaagatggccacggtggagctggccaccaggaagacggtgatggtgcgctcgacccgcggccgggcgcgcaactcggcgtggacccggcgataggcgaaggtggcgccggccagggccagggcgacggtcaccgccacggcggaggcaaagccggtctgctgcaggcggttatagtgctcggcggcggcggcgaaatcgggattggcggtggcgtggcccagggcggcgttgcgcacctcgttgatgatcacgtcgatgcgctcggccggcaaggcgcgcagggcctccggcaggtcggcgatgaccagggcgcggatcaggctgggctcgaaaaccagccacagggccaggatggcgaaggccggcaggccgcaccacagggccacccaccagccgtaatagccgggcagcgagtgaagggtgccgggatgatccgaggcgacggcgaaggcgcgcttgcgcccaagctggaaggccagggtcgagatcagcagcaggatggcggcaagggtgacggtctgcatggattgggcggcccggaaaaagaagcgggggaagccgtcatggcttccccctttgcgatcacatcttcagttcacccagggtgcgggcgttgttcgcctgctccttgcggatggcgtcgggcgaggcgatcaggcccttgtcggccagatagccttccttgccccaggccttgtccgaggtgaactcggtgacgtattccttgacgccggggaccatgcccacatgctgcttcttgacgtagaagaacagcggacgcgacaccgggtacttgttgctggcgatggcgtcgtaggtggcgaccacgccgtccaccggagcggccttgaccttgtcgcggttctggtcgagatagctgaaggtgatcacgcccagcgcggccgggttcgaggtgatcttctgctggatgacggtgtagttctccgacacctcgacccaggcgccgtcttcacgcacggtctggcaggccttcttcttggcggccttttccatgtccttcagctcgggctgcttggcgcaggcggggtcgaggaccagttccacataggcgtcgcgggtgccgtggttcggggccgggccatagaccaggatcggctccttgggcagcgacggatcgatgtcgctccagttcttataggggttcggcaccagcttgccgcccaccggcacgtccttggcggtggccttgtacatctgctcgcgggtcagcgtgaagtcggggccggccttggaattcatgaacacgatgccgtcatagccgatcaccacctcggtgatgccggtgacgccgttcttggtgcagaattccacttccgacggctcgatgcggcgcgaggcgttggtgatgtcggggaagctctcgcccacgccggaacagaacaggcgcatgccgccgccggtgccggtgctctcgaccaccggggtcttgaacttgcccgccttgccgaaggcctcggccacggcggtggagaacgggtagacggtcgacgacccgacgatgcggatctgatcgcgggcttgcgccgcgccggcggtggcgatgacggccagggcggcggcagcgacggccagggtcttggtggacatgaaacctccgggggagtgcaacgggacgagggagacatcagtcccctcggccggcatcctatcggcgctgtgttacagtccggggacacaagcatgaagcttttgtgacaggaatattaatcgttttaaatcaacgtgatgatggcctcgcgtagccgctggagggcctcttccaggctcgatcccgccaggttgccatagcccaggaccagccccggacacccttttgtgacacgatgaaagctcagcggcgagggcgccagtccccgggcgcgggccgcctcggccgcctggaaatcgtcgcatcccgcgggcagccaaaggatggcgtgcagccccgcctctccggcggtgaccggcaggttcgggccgaggatacggggggcggcgtcgagcaaggcgcggcggcgctggccgtacagggtgcgcatgcgccgcagatgggcaccgaaatggccttcggtcatgaaggcggccatggccgcctgggtcaggccggcgggcgccatgtcggcgatgcgtcgcgccgccacgaaggccggcagcagcggcggtggcaccaccagccagcccaggcgcagcccgggaaacatgcttttcgagaaggtgccgagataaagggtgcggccgccccggtctagcccctggagcgaggcggtaggagaaccggcgtggtggaagtcgctgtcgtagtcgtcctcgatgacccagccgcccacccgttccgcccaatggatcagggcaaggcggcgcgacagcggcatggtggccccggtggggaactggtgcgacggcgtgacgaaggtcagccgggccgacgggcattgccgttccgccagttccgggtcgaagccctggccatccacggcaaccgcctggacctgggctccggcggcgcgcagcacgccggtcagcccgccatagcacgggtcttccaccagcaccgcctcccccggttccagcaggacgcgggccaccaggtccagggcctgttgcgagccgcccatgatcatcacctgggcggggtcgcagcgcaccgcccggctgcggcccagatgctcggcgatggcatggcggagcggcgcatggcccaggggatcgatgccgcccatcagctccagcgggggccgccgccacagccgccccagcacgcgccgccactcggcatggggaaaggccgccagatcgggcacgccgggggcgaagggccggaacgggtcgcgcaccaggatcatgggcggggcggcgccccaggcccgggtgcggggcggcaggggcgacggcggggcttcttcgcccgccggggcggctcccacgagagggtggcgggcggcgacccgggtggccgagccccggtgggcttcggtaaagccctcggcggccaaaaggtcataggcggccagcacggtgttgcgggccacgcccagttgcgccgccaacccccgcgaggacggcagggcggcaccttccgccagccgtccgtccaaaatggagtcccgcaaggccagatacaggcgccgatgcaacggagcgtcaaggtcgggcagggccaagggcaggggagggggcatggcgctctcgggaagtggctccatgattataaaagaagtggatcttttcagggagccactttccgcccaatctgaataggaaaggagagccaccatgtccgccagaaccgaccgcaccaccttccgccagcggccccagcggggcagccacgatttcgacgccatggcagccattctcgacgaggccctgtcgtgcaccatcgccttcgtcgatgatggccgaccggtcagtataccgaccacccattggcgcatgggcgagcgggtgctgttccacgggggccagggctcgcgcctcgcccgggtgatggcggcgggcgccgaactgtgcgtcaccgtgaccctggtggacggtctggtgctggcccgttcggcctttcaccattccatgaattaccggtcagtcgtcctgttcggtcaggcggtggagatcaccgatccggccgagaaggcggccgccttcgccgccctgatcgagaagctgtcgccggggcgctatgcctcggtccggccacccacggacaaggagctgggggcgacgaagctgttggccctgcccctggccgaaggcggcgccaagatgcgctccggcccgccggtggacgacgaggccgacatgtcctggccggtctgggcgggcgtggtgccggtaacgatggtgaagggcgagccggtggcgggttaacccgtctggccgctttcacgcaggaaggctgcgtacttcacatcgaaggtcatgatgtgattgcacagccagtccttaagcaggcgggtcagctcgctgtcaacgctgctggcccccgacatcatcaggcggtcgatgatgttctccaactgaaagatcaggtgctcatgctcgtaggcatgggcacctctctcgggataggcggtccgatccatactggcgatttcggcggcgaaatgccgcttggtgtaggagctcaggtcgccgattgcctgattgaccgccgcctctccgtgagtgggggaggccagcagacggttcatcagttcgaacagcttcttgtggtcgctgtcgatggcttcgacaccaaccaggaggtcgtctgaccaggaaatgtgctcgctcatagaactgaccccgccattcaggatatgtctatagtatcctatggctgcgccaattgccaagggggcgtcagcgtcgcaacgccgcgatgttggcggcatagtccttggtcttgaacaccgccgaaccggccaccaggacgttggcgccggcggcgacaacgcggtgggcgttgtcggcggtgacgccgccgtccacttccaggtcgatgggccgcgtgccgatcatcgccttgatgcgggcgatcttgtccagttgggcttcgatgaagctctggccgccgaagccgggattgacgctcatcaccaggacgaggtccagcttgtccatgacgtattggatgacgctttccggcgtggagggattgagcgacacgccggccttcttgcccagcgagcggatcagctgcagcgagcggtccagatgcttgtcggcctcggcatggaccacgatgatgtcggccccggccttggcatagtcctcgatatagggctgggccgggtcgatcatcagatggacgtcgaagaccttggtggtatagggccggatggccttgatgatggccgggccgaaggtcaggttgggcacgaaatggccgtccatgacgtcgatatgcacccagtcgcagccggcctcgtcgatggccttgacctcttcgcccaggcgggcgaaatcggcggacaggatgctgggggcgatcttgacggtcatgggcttgggtcctgtcttagaaatcgtcatggccgggcgtgacccggccatccatgggacccccggggcgtgaagttcaccgccgggctggcctttcggccagacccggtggcccgggggtgacgaaatgatagaagcttctcagttcaccttgggagccagggcgcccttggcatacagcgcgctcatgtcttccaggccgaccaccttgatcttcgaggcctggccggaggtgccgaaggcgtcgtagcggctcttgcagacctcgaccatggcggcgatggagggcttcaggtagtcgcgggggtcgaacttcttggggttgtcgtggaagtacttgcggatgcagccggtgacggccagacgcaggtcggtgtcgatgttgatcttgcgcacgccgtgcttgatgccttcgacgatttccccgaccggcacgccataggtctcgcccagggcgccgccgtaatcgttgacgatcttcagcaggtcctgaggcaccgaggaggagccgtgcatcaccagatgggtgttggggatgcgggcgtggatttccttgatgcgcttgatggccagcacttcgcccgtcggcggacgggtgaacttgtaggcgccgtggctggtgccgatggcgatggccagggcatccacctgggtcagcttgacgaattcggcggcctcgtcagggtcggtcagcagctgggaatggtccagcttgccctcggcgccgacgccgtcttccttgccggcggtgccggtttccagcgagccgagacagcccagctcaccctcgaccgagacgccgcaggcatgggcgatgtcgaccacctgcttggtgaccgccacgttgtaatcccaatcggacggggtcttgccgtcttcccggagcgagccgtccatcatcaccgacgagaagccggactggatggcgcgcacattgatggccgggctggtgccgtggtcctggtgcatgcagaccggaatctggggataggcctcgatggcggccaggatcaggtggcgcaggaagggctcgccggcgtatttgcgggcgccggccgaggcctggaggatgaccggggcgtcgcaggcggacgccgcctccatgatcgccttgacctgctccatgttgttcacgttgaaggcgggaatgccgtagctattctcggcagcgtggtcgaggagctggcgcatcgaaacaagggacatctacttcatctccttcctggcgttttgccgccgtggtcgtcttagaggcgagcctgggccgcgtcggccaccgcttgggcggtaatgccgaaatgctcgtagagtttctcggcgggtgccgaggctccaaagccgttcatgccgatgacggcgccgttttcgccgacccagcgctcccacccgaaggtgcccagcgcctcgacggcgacccgcacggtgccttcacccaacacggagttacgatactccttcggctggcgttcgaacagttcccagcagggcatggagaccacggccgccgcgatacccttgtcggccagcagcttgcgcgcctccatggccaggctgacttccgagccggtggcgatcagggtgacctgacgcttctttccctcggcctcggccagcacataggcgcccttggcggtgaggttctcgtcggtgtgggtggtgcgcagcgtcggcaggttctggcgcgacagggcgaagaccgacggccccttggcattgtccagggcggcctcgtaggcctccatggtctccaccggatcggcggggcggaacaccagcacattgggggtggcgcgcagggcggcgacggtctcgatgggctggtgggtggggccgtcctcgcccaggccgatggaatcgtgggtcagcacgtagagcacccgctggtccatcatggcgctcatgcgcagcgccggccacagatagttggcgaagatcaggaaggtgccgccataggggatgaagcccccatgcagcgacaggccgttcatgatcgaggccatgccgtgctcgcgcacgccgtagtggatgtagcggcccgagcagtccgaggccgaaaccggcttggtggccttggtgatggtcaggttcgagtgggtgaggtcggccgagccgccgatcatctcggggatgacgggggtcagggcttcgagcacttcctggccggccttgcgggtggcccatttgggctgctcggccgaaaccttctgcttgaaggccgacaccgcctgcttccagccctggggcagggtgccggcattggtgcgcaggaactcgtccttgcccgcataggcggcgaagcgcttctcccactcggcgcgggcgctggcgcccttggtgccggcggcgcgccaggcgtccagcacatcggcgggaatctcgaagggaccggcgctccagccggcggcggcgcgcgccgcggcgatctcgtcgccgcccagcggggcgccgtggaccttctcgctgcccgccttggtgggagcgcccttgccgatggtggtgcggcaggcgatcaggctgggctggccggacttctgcgccgcggcgatggcggtggcgatggcctcggggtcatggccgtcgacgcggcacacatcccagttggacgcctggaagcgggccagctggtcgtccgaggtggaaatggcagtgtcgccgtcgatgcagatgtggttgtcgtcccacagcaggatcagcttggacaggttccacaccccggccagggagatggcttcctggctgatgccctccatcaggcagccgtcaccggccatgacataggtgtagtggtcgaccacgtccttgccgtggcgggcggcggccatcttctcggccagggcgaagcccacggcgttggcgacgccctggcccagcgggccggtggtggtctcggcgatggccacatggccgaattccgggtggccggcagtgcggtagcccatctggcggaagttcttgatctgctcgatatcggacagatcctcgaagccggtcaggtagcccagcgcgtagagcagcatggagccgtgcccggccgacaggatgaagcggtcgcggtcggcccatttgggggccttggcgtcgtatttgagaaagcgcgtgaacagcacggtggccacatcggccatgcccatgggcattcccggatggccggatttggccttctcgatggcgtccatggtcaaaaagcggatggcattggccattgcggcgtgggtggtcatcgagcaaacctcaagggtgaagggttcaagtcaggcgcggcggtgccacgaggtcaacatctggcgaggcccggcggcccctccgatcaacagggtctgggtcttctccaggtctcggctgcgctcgacgccgtccagcagcaggccggtggtgatgccggtggcgcagaacaccacctcatccgagcggacgatctcgtccaaccggtaccagcgcgccagatccatgcctgcggcctggacggcggcggcctcggtggccaattgcgggtcgatgcggcccaggaactcgccgcccatggcgcggatggccatggccgacagcaagccttccggcgtgccgccggtgcccatcagggcgtcgatgccgctgccgggaatggccgccatcagggcgccggccacgtctcccgccggatagagagcgacgcgggcgcccgcctcgtggatggcctggaccagcgccttgtgacgcggcttttcgatcacgtagaccgtgatgtcttccagcggcttgttcagtgccgcggacagttgcttcaggcgttcggccgccggggcctcggggtcgatcttgcccttggcggcgggcggcgccgccagcttttccatgtagcgggccggggcggggtcgaacagggtgccgtggggcgccatggccaccaccgccatggcgttggtcatgcccttggccaggaacgaggtgccttccagcggatcgaccaccaggtcccaggcaggctcgcccgatccggcgccgaagcgctggccgtggtagagcatgccgatctcgtcggcggggccttcgcccaccagcatcaggccgtccaggttcagacggtccagttcggcctgcatggccgccacggcggcatcgtcggccagggccttgtctccgcggccgatccaggcataggcggcccgcgccgccgcctcggtggcgcggcgcagttcataggctccgacggtcatggaacgctcggacatgccctgtgatccttccccggaatcccctggttcatggagacgtgttttggccgatagtgggggggcaggtcaagcaaaggaacacccgttcgggcctgcccgcaagattcttgtggataggtccgaagccgtccgaaggggtgggggcgggcgggaggcgacgcgaccccgccaagggccgcgccgccgctgcctgcggagcgctactccgccgccttggccaggggcagcatggagccggtgcgctggaaggccagatgccattcgaaggcgcgctccatgacatggggcgtgtggccgccccggcccagggcgtccttgaggtagtcccgcgccagatcccggtagtcggggtgcatgcagtgctcgatcatcagattggcccgctcgcgcggcgccagtccgcgcagatcggccagtccgcgctcggtgacgatgatgtccacgtcgtgctcgcagtgatccacatgggtgaccatggggacgatggaggagatgcggccgtccttggccatcgacttggtgacgaacaccgagagataggcgttgcgggcgaaatcgcccgagccgccgatgccgttcatcatcatggaggcgttgacgtgggtcgagttgacgttgccgtagatatcggcctccagcgcggtgttgatgcagatcagacccaggcggcggatgacctcggggtgattgctgacctcctgcgggcgcaggacgaggcggtccttgtacttgccgatattgccgaacacctccttgccccgggggccggagagggtgatggacgagcccgaggcgaatttcagcttgccggaatcgaacaggtcgaaggtgcagtcctgcaacacctcggaatacatggaaaggtcgtggaacggcgaatcgatgaagccgcccaggacggcgttggcgatggagccgatgcctgcctgcagcggcagcagcgaggtgccgatgcgccccttcctgacctcctggcggaagaaatcgatcaggtggtcggcgatggccttggtctcggcatcggccggggcgatgttggccgagctgtcgtttttctcggtgatgacgatggcggcgatcttggagggatcgaccggaatgtagggcaggccgatgcggtccgacggcgtgaccaggggaatcggctcgcggtggggacgtcgcgtcgggatatagacgtcgtgcaggccgatcaggtccaggctctgatgcaggttgatctcgacgatgatcttctcggccaggatggcgaagctggcggaattgccgatggaggtggtggggatgatgccgccttccggcgtgatggccaccgcctcgatgacagccacgtcgatgggcgccatctggcgcgaacgcagcatctccaccgtctccgacaggtgctggtcgacgaacatcacctcgccggcattgatggacttgcgcagggtgggatcggcctggaagggaatgcggcgcgacagacagccggcctgggccagggtcttgtcgatgtcgctgcccaggctggcccccgtcatcagggtgattttcagtttctcctcggtggcccgctcggccagggccatgggcaccaccttggcgtcgcccgcccgggtgaagccgctcatgcccaccaccatgccgtccttgatgtgcatggccgcctcttcggcgcccaccaccttgccccacagggaggtcaatccgattctgtcgcgatacatgcccgtttccttatcccagatggcgcaactcggcgcgctcgggcagaacggtagcggacgggggagggggcaggcgaaatgcagagtttgcacggccccatgcatgtccgaggcgcagggccgcatgccctgcgcgacgtccgcagcaataattcagcaatagtttacggctagggttcttcgtacttcatccgaatcggacatgcgaagaactccagccgactggggaagatccccgcttgcgcggcagggcgaccgtcctgacccgttcggaggctgtgcctcccggtttggggatcgggggcaaaagcccgcttaggtcaggaaaaggccttgaaggcgatcagggtgaaggtgtccttgacgccgggcaggcgctggatggtgtccaccacgaactggccgatatcggccgagtcgtcgagatagcacttcagcatcaggtcatactgaccggagatggagtgcacttcggacacctgttcgatgtcgacggcttcgtcggcgacctgataggccagccccagttcgcacttcacctggacgaagatggtctgcatgggaggtctcccgtcgtgtcggcgagccaccggagtgactcgcccattatgccgtcaatcctcggaatcggcgtccaggtcggcgtcggcgtcgctgtcgtcgtcgacggtggacttgctggtcttgaccggcagcggcaccgcggcggcgatgaagtcgggcatgtggtcgccaaagccgatcacgccgtcgggatgcagcatctcgccgatgcccagctcgtcgatgcggccacggcggcgtccgccgcgctcgtcccggcggccttcgtcgcgattgcggccgccacggcggggctcctcgcggcggggttcgtcgcgccggggttcttcacggtcccggccacggccacgggagcgctcgggacgttcctcccgggggcgctcgatcacctcttcgggggcggcggcttcgacgggggcggcctcggcgaccggggcctcgtcacggcgcgggcggcgctcgcggcggggcttggcctcgtcgtccttgccacgggccgggcgcttggcatccttgggggcgccgcgtccgccacggcccttgcgggcggtcatgtccaggtccagggcgggaacgccctcgaccgagatgcggggaatggtggtgccgatcatggcctcgatggcgccgacgaagcggccgtcatcagggctggcgatggtgaacgcgtggccttccatgccggcgcggccggtgcggccgatgcggtggacgtaatcctcggcatggatcggcacgtcgaaattgaagacgtggctgaccgccgagatgtcgatgccgcgcgcggcgacgtcggagcagaccatcaggcgggcttcgcccttcttgaacttctccagcgtttcgccgcgggcgctttgcgccatgtcgccgtgcagttgcaccacgtcgaagccatgcttcttcagggagcggaacagcacgtcgacgtcgcgcttgcgattgcagaagatgaaggcgttcttcacttcctcgatgcggatcaggtggcggagcgtctcgcgcttgtcgatctcctcgaccacggccagggcctggaccacggtggtggcggccgaggcgccggtggagaccttcacttccttcgggttcatcaggaaggcgtcggccaggcggcggatctccgggcccatggtggccgagaagaacagggtctggcggatcttgggcagcagaccgacgatcttctccacatcggggatgaagcccatgtccagcatgcggtcggcttcgtcgatcaccaggaccttgacgtcgttcagcagaatgcggccgcgctcgaacatgtcgagcaggcggcccggcgtggcgatcagcacgtcgacgccgcggtccagcagggccacctgatcgctcatggattcgccgccgatgatcagcgccttcttgagcggatggtacttgccgtatttatcgaagttctccgccacctgggcggccagttcccgggtgggagccaggatcagcgagcgcggcatgcgcgccttggcgcggccggctgccaggatctcgatcatgggcagcgtgaaggacgccgtcttgccggtgccggtctgggcgcagcccagcacgtctcggcccatgaggaccacagggatcgcctgtgcctggatgggggtggggtgcgtataccccgattcagcgagcgccttcagaatctccggcccgaggccgaggtcttcgaaggtggtcgtggcggtttccgggccgtccgagcggccgatgtcgtcatgggtcgtcatgtggggcgggataatagggtttcggcgccttaagtcaatgacggaacacggtttccccattgtagcctgcctggaggcgggtttaggctggtcccggaccccaggaggacgcccgccatgctcatcgaagccccccgttcaagcctgctgatcgtcgacgtccagcaggggctggcgccggtcatgagcgacccccgccgggtctatcgcggctgcattctcctgttgcgcgccgccacccgcctgggcttgcctgtggtgctcaccgagcagtaccccaagggactgggcgccacctcgggcgaggtgatggaatgggcgcccgagggcgcggtgatggagaagctgcatttctcctgcgccgccgacgaggccattctcgcccgcctcaaggggacgggccgcgaccaggtggtcattgccggcatcgaatcccacatctgcgtgctgcaaagcgccctgggcctcctggcggcgggcttcaagccggtggtggtggccgacgcctgcgcgtcccgcgatcccgccaattatcaggcggccatggcgcggctggcggccgcgggggtcggcgtcgtcaccgtggagatggtgatcttcgagtggctgcaccgggccggaacgccggaattcaaggagctctccgccctgatcaaatgatggtggcgggccggggttcggccgcgctatccctggggggcggctcccgggggatgcgtggccggttttcatgctaagtccatgagaaacaatggtgaacgccggaggggaaacaaaaacttcagccgccggaaatttttcccttttcatcgcccgaaaacggcgtatatagcggcttcaggtgagacgtacagcgcacgtgcctctggcccccgagggggtttaagtaacgacgtccaaggcgtcttctgggtgcaagcggggtgaaagcccccggtgcttggaggaagtagctatgaacgtggtggctcggcagtcgctgtcgatgaactccaatcctctcttcgcaaacggattccgtccccggcaggcttgggcgctgctgtgggtcgatgtgcgaagtacctcccggcggatctgacggcttcccgaattgccgccacctgaacgtcgtcccgccgcttgaatgcggtgggccgagcggagagagttttcgggccgatccaatgcccggcctgttcgagaggatttcgcgatgaccgcgaagatcgcccgtttccttgaggaagtgcgccccgtcaccccctgcgtcgtcgtcgacctggacgtggtgcgcgacaattatcacggcctgcgacgctggctgccgctggccgaggtctattacgcggtcaaggccaatccggcccccgagatcgtgcgcatgctgaccgaggagggttcgcgcttcgacgtggcgtcgcggggcgagatcgacctgtgcctggccaacggcgcgcccgccgagcgcatctcgttcggcaataccatcaagaagcagtcggacatcgcctacgcctatgccaagggcgtccgcctctacgccttcgattccgaggccgagctggagaagttggccgaggccgcgcccggctcgcgcgtgttctgccgcatcctgatgacctgcgacggcgccgagtggccgctgtcgcgcaagttcggctgcgagatcgacatggccaaggacctgctggtcaaggcccgcgagatgggcctcgacccctatggcgtgtccttccacgtgggcagccagcagaccgacctgcggcaatgggacatcgcggtgggcaaggccgccatgctgttctcggccctggacgccgccggcatcgagctgcgcatggtcaatctgggcggcggcttcccggcccgttaccgcaaggaagtggatggtctcgagcgctatgccgaggccgtcatggacgccatgaccaagcatttcggcaacaacatcccctccatgatcatcgagcccggccggtccctggtgggcgacgccggcatcctcgagaccgaggtggtgctgatcagccgcaagggttatgacgacgacgtgcgctgggtctatctcgacgtgggcaagttcggtggtctggccgagaccatggacgaggccatcaagtaccgcatcgtcaccacccgcgacggcgacgacaccgctccggtggtgctggccggtcccacctgcgattccgccgatatcctctatgagaaggccggctacgagatgccgctctctctcaaggtgggcgacaaggtgcgcatcttgtcgacaggcgcctacaccacctcgtactcggcggtgaacttcaacggcttcgagcccttgaaggcctactttatctaggcctctcctccgtaggatcgaggccaaggcccgcccggcaagttctgccgggcgggcttttttgcgcccaggatccggcagttcctgccgccttctggtcggctaactatctgaaaaatatcggttcagcacttggcatcgaccttgcagatctgaaggcggatcaatgtccgtcgtgtacggaggcgacgatgttatttggggctttcaccaacgccagccaggcgatgcagacgatggattgggccatgggctcgatctcgcagaacatcgctaacgtcaacacgaccgggtacaaggaaaaggaaaccctgttcaagacggtgctgtctgaaacgcacacctcgccgcccaccagccagaattcgccgaccaagaataccgcgaccaccggattggacatcttcggcgtgcgggcggtggaccgcaccatggtctccaagtcgggaaccatcaccgcgtccaccacctggagcgatatggccatcaacggccgaggcttcttcatcgtgactccgcccgacagcaccggtgccccgcagaccactctgtcgtcgtccaataccctttacacaagggccggtgacttcacccagcgggcggtgaacgggaataactacttcaccaccgccgacggcaatttcctcatgggctgggccgccgacaacctgggcgtggttagcaagaccctgagcccggtctatgccaatctcgggcagaaaagcgacggcatggccaccacctccatccaactcgtcgccaatgtgccgtccaacgccaccatgaccggggcgaccaagacctttaccgataccaccagcgtcaccgacggcttcggcacggcccaggacctgaccatgacctggaaccgggtgagcggcgacacctggacggtggatttctcgctgcccgccaatccggccagtggcagcgtcggcaccatcaccggctcgccggtcacggtggtgatggatgccagcggcaacatcacctcgccgaccacctcggcctcgggcactggattcgcggacctgaccttcgactggtcggccggtcccaccatgcagaacaccgccagcatcaacctcacgtccaacaagccgacggttcaggggatcagcgagaccatcgccgtctatgacggggcgttcaattcccataacctgaccatgaacttcgagcatgcctccaatgggcagtggtacatgagtttcacccccgtggcggcggaaggcgcggtctcctccctgaccgccgacggcactgcctataccaattccatccccattaccttcgacggtgcgggcaacatcctgacccccgccaccgccgagctgaccgtcggctggacggcggcgggtgctggctccaacaccattaccctggatatgcgcaagctgacccagttttcgggcgaaaccaacaacaagctgggcgtcaaggtcatcgaccagaacggctatgccagcggcaccatggacaaggtggaaatcagcaccgacggcagcgtgatggcccattacgacaacggcgagtcccgacggatcttccagattccggtggctagcttcgtcgcgccggaccagctcgacgccatctcgggcaccttgttccgtgccaccgagcaggccggcgacatgaccgtcgcttccatttccgatcagggcagcggggccagcatcgttgcgtcggccaccgaaagctccaatgtggcgctggaggatcaattcacccggatgatcgtcacccagaaggcctattcggtgaactccaacgtcttcaagaccgccgacgagatgacccagaccatccgcgatctgattacttgatcttgtccctcggtcgccttgcgcctgcggggcctcgctatcggcgccaggctttcagccgccttgccgcctcggccatgtgttcggccgagcccgcataggagaagcgcagggtccggtgcccttcgatgggatcgaaatccacgccgggcgtgcaggccacgccggtctcggccaacatgcgggcgcagaactcgcggctgtcgttggtcatctccgacacgtctgcatagagatagaaggcgccgtccgagggcgccagccggtcgaatccggctttcggcaactccgccaccaggatgtcgcggttggcgcggtaggcggcgacccgggcctccagctcatcgatgcagtcgaacaccgactccgccgccacctgggacagggtggggggcgagatgtagagattctgggtcaggcactccaccgagcgggccagatcttcgggcagcaccatccagcccagtcgccagccggtcatggcgtagtatttggaaaagctgttgatgaccaccgcatggggggcggcggccatgccggcggcggtggcggcggcgcgaccataggtgatgccgtgatagatctcgtcggagatcagccggatgccgtgcaattcgcaccagccggccagttccgccacctcgtgggccgacagcatggagccggtggggttggacgggctggccaccaccacgccgtccagccggccctcgacgccggccaggacctcggcggtgatctgccagcggctggagggtcccaccgggaccagcacgcactccacccccagggactcgaggatgttgcggtaggcggggtagcccggcgctgccacggccacccggtcgcccggctcgaaggcggccaggaaggccagcaggaaggcggcggaagaaccggtggtgacgcagacgcgttcaggcaccaccgacaccccataggcctggtggtaatggcgggcgatccgctcgcgcagggaatcgcggcccagcgccagggtgtagcccaggggctcggtcctgacggcgcgggcggcggcgtccagcaccttaggcggagcctggcccgagggctggcccacctccagatggatcacgtcggcgcccgccgcctggcgtgccgccgcgtcgcgcatcacgtccatgacgatgaagggggcgatggcgccccgcctggcggccttgaaagtcattccttcttgcctgccacgctggccaggccgaagccgcgcggatcggtacccatgtcgcagccctcggggttcttgaagccctgcgggcaataaatggcctcaacccggctgggcatgggggtggcgctgatctggtgaccgcggctggccaggggggcggggtccagggaaatggcgccggtctcgacaaagacggcgtcgggcttgcccgcatggaccagacgcggctgggccagggcctcggacagcggcttgttgtccttgacggcggccaggaaggtctgggtcaggcccagggcggcggtgccgccgcccgaggcggcgccgacgaagcggacggcgccgttatggctgttgaaggtgaccatggcggcggtggccggcgggccgttcatgccgggaacacccgacagtatgatgccggtgccgggcgccatgcggccgttgccgaacaggccgtggttggtgacgctgcatgccaccgccatgccgttgacgtcgagaacggcaaagccggttcccgactggctgtcggtgggcggcgcggcgacattggccaccggctggtggcggtcggcggcatagccggccatcatggtggcgatgcgcgcctcgctcaccagggagtcgggggagtcgtcgctccatccggtggggcgcatccagcgggtgcgctcgccaaaggcccgggccgaagcttccgccagcagatggggccgctcggccgcgtcggcatcgctccagcgcggccacagggcggccaccagttgggcggccatggcgctgccaaccgatggcggcggggagaaggccgcgatctcggtatcggtcttgacggtgatggcgtcgcgccagacggggcggatgtcgcgcagatcctccagcgacagggtgccgcccgccgcccgcacggcctggaccaggtcacgggcctgggggccggcatagaaattgccggtctggtggcgcagggtcgatatcactccggccagatggggctgtatcagcaggtcgccctcgcgcggcaccgagccgtcggcccgcatgaacacgtcgcgtgtcgccggatcacggccgatgatgggcaggccgcgggccagatcgttggcgaaggcgcgcgatatggtcatgccgctgcgggccagcttttccggctcggtcagcaggctttcccagcgcaggcggccatacttggcgtgcagcgcgtagaagccgcggggattggcgggaaccgccgaggccagctggccggaggcattggaggcgatggcggggaaatcgatgacttccgtcttctttttgccgctatcatgtactatgcaggttccaccaccgcccaggctggcggtggacgggtaggtgaccgccagggtgaagtagatggcggtggccgcgtcggcggcggtgccgccggacgacagcacgtcgcggcccaggatggcggcacggggctcgtcgacggcgaccatgccaccgaagccggtgatatggcccacctggccgacgggccgggcgggatcgccgcaggcagacagcgccagcagcaccgtcgcggcggcgacgggaagagcggatttgcggccgcgcaacgaattgaccgatgaggagagatccttgctcacgcgcattatccttctggtgacgttcctgttggtcgcttcgatgccgccggctttggctcaatcccagccgaggcggcagttcatccgtgacgccgaggtggaaaataccatccggactttcgggacgccaatttttcaggcggccgggctggaccccgcggcggttcgcatcaatctgatcatcgacccgaccttgaacgccttcgtggcgggcggccagaacatctttttccacaccggcctgctggtgcggtccgagcatccgggccagctgatcggcgtgatggcccacgaaaccggccacatcgccggcggccacctgatccgcagcaccgaggcggtggccaatgcctcgaccgaggccattctcgccaccttgctggcggcggcggcgggggccgccaccgggcgcggcgacgtgggcatggcgggggcgctgggcggcaacgagctggccatgcgcaatctgctggccttctcgcgcagccaggaaagccaggccgaccagatggccatgcgctttctcgacagcacccaccagtcgggcaagggcctgctggagttcttcgacattctgggcgaccaggaggcgctggtctcgtcgcgccaggacccctatgtccgcacccacccgctgacccgtgatcgcgtctccttcgtgcgctcccaggtggaccagtcgccctggagcaagactccctggtcgccggaatggatcgagatgcaccggcgcatgaaggccaagctgttcgccttcatcgagccgcccatccggaccttccagcgctacaaggaggccgacaccagcatcgaggcccgctatgcccgcgccatcgccgcctatcgcaagcccgatctggtcatggccctggggctgatcgacggactgatcaaggaacggcccaacgatccctatttctgggaactgaagggccagatgctgttcgagaacggccgaggccccgaagccatcgaaccctaccgcaaggcggtcaagctgctgcccgacagcgccctgctgcgcatcgccctggggcaggtgctgatcgagagcgaggaccagtcgctgctgaccgaggccgagaaccacctgaccgccgccgtcaaccgcgagccagaggacgtgttcgcctggcagcaactggccatcgccttcgcccgcgacggcaaggagggcatggcctcctacgccctggccgagcattacatgctggccggcaagctgtcggaatccctgttccacgccaacaaggcggagcagttgctgggcaagcagggctccatctggctgcgcattcaggacatcaaggaacgcgcctcccaggtcaaggccgaccgcgaccgggcccgcaagtggtggtagtgctgcaaggccttgcgacaagcagccgcttccgccaatatgcccgccatccttttgcctcttgaggtagctttgccgatgatcgccaagactttcgccgccgccctgatggtgtcgggccttgcccttgcctccctgcccgccgccgcccaggaggtcccgctgacccccaagcaggccgaggcggtcaagaaggtggtgcgcgactacctgatggagcatcccgaggtgctgggcgaggctctggaagctctgcgcgaaaagatgcgcgcccaggccgaggccgacgcccacaagatgctcgaagcccgcaaggacgagatcctgaagaacgccgacgatccccaggggggcaacctcaagggcgacctcaccgtggtcgagttcatggattacaattgcggcttctgcaagcaggccttcgaccccctgtgggaagcggtcaaggccgacggcaagacccgggtggtgatcaaggaatacccgatcctcgggccggattccgtgctggcggcccgcgtcgccctggtggccaaggcccagagccaggccaagtacgacgacgtgcaccgcgccttcatgaagttccgcggccgcctggacgaaaaggccatttacaagatcgccgccgatcagggcttcaacgccgagcagctgaagaaggacatcaacggtcccgagatcgagaaggccctgaagaagaacatggacctggcccgttccctggagatcggcggcacgcccaccttcatcgtcggtgatcgcatcatctccagcgcgctggaccagcagaccttgaagcagctgatggacgcggcgcgccgctccgccgccaagcagggcggctgaccggtcccgccgtcacggcgacgaaaaagcccccggccgcgaggccgggggctttcttcatgcctcagcccggagtcaggtcgatggaaagcatcgcgcagcccagggccgtggtcgcactgccgccaaagccgcaaagagtcacggtctgggccgaggtgacggtggccggcgcggtgtactgtgccgtcatcaggccggtggcgatcaccgagccggcttccggcatcatgcaccacagcgcctgggggatgcccaggctggtggtggcggtcagcaccgcactctgacccgccgacagcgaggtcaccgggcaggtcacgttaaaggcctcgtcgaccggcaccacgttccaggtggcggtggcggtgcccgcgctgctctgggcggtgatggtgaccggggtgggggccgacaccgagccggggggcgtgtagaaccagtcgccctccatgttcttcttggccacgcccaggctggctgtgaaggtggcgttggaatccacctggccatcggcatcgatggcctgcagctggaacgatgcgccgccggcggccagggtgacgttggcgggggttatggtcagcgccgccagggtcggagacaactcgaccagggcataggccacctgctgcaggtcgccggcgttcagggcctggatcaccactcgcgacggggcggcaatctgggacggcgcggtgtagactccgttggtgacgctgccgatgggcggggtgatcgaccattccacctgggcgacggcctgattgaggctgagagtcacgctctggccagccgacagggagctgatgccgggcgacagcgacaatgggctttcgatgttgcccgccgtgtagaagtcgcagggaatggccgcattgttgatggcgacaaggcccgaggccgggaacagcaggttgtcgatcaggaaggtgctgacctgcggcaggcccaggttgtcgagccagccgccgagggcttcgttgatgggatcggtgatcgatgatcccagattcacatcgccttcgaacagttcctgccagatggagaaattggtggtcggctcggtgttggtggcgaaggaaccgctgaacgccacggtgtcgttggtggcgctggtcaccgtcgggaccagcagcgccgtcgaggtgacctgaaggccaaccgtctcgagattgcggttctcgatcacgctgttgaaggcgttggtataggtgatggaggtccagagctggttccagtcggaggtccaggagaaacccatgccgctggccccgggagtcatggtcatgccgctcaggggcacgtagaggtccaccggattgtaatcggcgtcactgctccacacgccgccctgcagggcgttgccctcctgaatggtgcccacgtccaggctgccggcggtgctgaccgtctgataggcggaggaggctccgatggtctgataggtgaaattgccattctgggccttggtggcctggttcatcaggtcggggaacacctcctggaacatcacgcggttggacaccagcacacccacggaactgcccgagggaatgatgtccgccgagggcgcgttgccccccgcgctgccgtcggtggtgatcagcagcatcaggttggagccgggattgttgacggcgttctgggtggagaaggtgaacgaggtgggggtcagcgccgccagagtcccgctggtattgaccgagcccagcgtatagatcagcggattgctgctgaaatagccgccgatggcgctgaaaatctcctgggcctcctgcgagttcgccacgacgcccgccagctggccggtccactggccggtcagattcttggtctgggcgaagtcgatcaccacgctgccgctgttgtcggcgccctgggcggtggtcaggggataggtgccgatcagggtcgagccgctggacccgtaatccaccatgtagctgggattgcctgcggcatcgatctgaagcaggcagccggcgtagacctggtagctgagctgggcctgatcgctgacgaattgcagcatggggggcgcgacccgcatggaaaaggcgtcgtagatgccgtccaccaccggggacaggcccgacaccgccacctgggcatggttctgggcggcataggtgctgaacagaaactggtcgagctgctgctgtcccagggacacgacggcgtcgtagtcggacgtcgacggcgcggtgagcgttgccgcgatctgggcaaagctcatggtctcttgctggatattggtgctcattgtcgtctcctccccgcgttcctattggccttcctgttccatcttcagctccagggtcggcgcgaagaagttcaggaacatgttgatgaccgtcatgacgccgacccagatggcccccgcagtggtgtcacgcaccgacggcatgttgctcatgtccaggatgtcgggaatgggatcgatgatccggtaggcggtctcggccgacgaacagctgttgttgcacaggtaatagatgttggcccccagttcggccgcgcggcagaagccggcgatcaggcgcatggcgacatagccgccggtgccctcatcctcgcccgggccttcgcggccttccggatcgtcctccttcatcagggcgttgacgccccggctgatggcggcgggcagcttgaccagcacccaggaccaggcatcgggctcatcgatgaggtcgtcccaggtcaggtcgtcctcgttgatgacgtgcagcaggaagtccgtgaaggacaggccgcacagggtccattcgatcagctcggggttgtccggcccggcgatgtcggagaccagccgggggatgtaggccatgatgttgcagatggaaacgaattccatccagccggtgggaatggtgaagcccaccgacccgggccccttggcgccgggggcgctgggggcgtagggcagcgggtcgccggccgggaagggctcgccgttatcgggataggccagcttgtagaacaccgtgccggggaaggcgatgatcagggaaatgaccgccaccagattgaaatcggcatcgtcgggatagccggccttgcccgccatccaggcccagagatcgcccaggaagccgtcgcccatggaggcggtcagggcgtctccgacggcggcgatggcggcgatggccaagtcgaacagcacgtcgaccacgcccttggccagttccagaaagccgtcgatcagggcgcccaggccatcgacaaaggcgggaagacctagggtggcaaaggcctgggggtcgctcagcgtgctgctgaggccttgccagaaatcctggaaggcggtgtcgaaatcgccgcaggcgccgttccaggcggtggtgaagtcggtcagagcctgctgcagtgcgtcaccgggcgtgatggtctgggtattgacgccgccgttggaattgacctgatcggacagccagctcccctgaacattgctggtggtgccggcggcgctgaggttgccggcctggggagtggaactgggggcgttgcccggcgattggccgccggtctggctcgacatggtctggttggcgagggtgccggccagttgggtgaagtaggccttgaccgtcgcctcctcctggtcgaaccagccgtcggcggcgcttttcatggtgcccaggccggtgatgcaactgcccaggccgttcaccagacaggactggatggccatcttggtgcgccagatggcgccgaaatccagcagcgcctccagccaggaaatggcggtttcgatttcggcgccgatccactggaacacgccgccgatgaactgcgccgcctcctcgatgccgtggatggccatgtcgaacgccgccgagatctcgtcgccgatcttcaccaccagggtggcgatctgcttggccaggtcgaccaccgccgaggtgatgatgatgacgccgttcttgatgccctgccagatgtcgccggcccagtcgccgatatcgctccagatgctgccgcagagcggcgaggcggcaaggtcgctccgctccgtccgcacctcgtcgtggctgtgcagatggcggaaggtggcctggccggtcttgggatcgaactgaacggcgaagcccgccgtggtgccggtgccctgtcccgcctgggcgccgccgatgatggcctgggccgccgccttggccaaggcggggttgcccttcagattgggggccaggggctggttgtcgttgccgattgtggccttcgacaaggtggtgccgtccttgtcgaacaccggcagcgccccgccggggttataggggttcagggtcccttgacccgacaggtaggcctggatgtccgaggcgggctggaccgtggccagggtggtgccctggcaggacagcaccagaccgggcgcgaacaggctgctggtggtgaggatcgatgcgacgatattgccctggccgtcggtggtcaccgtcagcggcgactggctgccgaggaaataggagttgccgccgatggtgatgtcggccgcgctggagccgggactcagggccagggtcaggctctggttgggcatggggcaatagttctggtccgagaccgccatctggaccttgaagcgggtgacctcgtaaatttcggtgccgctggtcaggaccgggttgctgacccagttgccggtcccggcatcggccagccacaggcatagcgccccttcctggtcatcgatggtgaacaggctggtgccgtcggcggggttgagatcgccgaacacgccggccacccccgcgcccagggggacgggagaggaaaagaccgggttgccgttcatgtcccagggctcggtctggctctgatgcatgacccacaggcacagatcgctgtccaccatgtacaggtcgaggacgatgccgagatccgtgacattggtggcatgtccgccggcgtaacgcaccgaggtcccggtgggcagcgacgcgcccaccgccgtggcgggctgcccgcccggcgccacggtgtagacctggccggactgggaggtcatcaggaagatgcagtcctgctggatgctgctccagaagcccagcgacacctcggagatcagggtgccggagggcagggactggaaggtgccggtgttgagggcgccggtgtcgcccaggctgccggtgtaaaggctgggcacattgttctggacgatcaccgcgttccagccggtctcgtcgaccatcaccagcgaggcgctgttgccggccagggtgccgcccacgtcgcaggaggtggtggtaaaggccccgttcagcgtggtctggtaggcgaccaggagatcgcccgccgcggtgcagccgtagaccaccagctggccggcgggggaataggcggtccccaactggctgaccccgcccgcgaccacctggaccggcgagccccaggtgacgccgtcggcgcccagggcgatggaccacagggcggctccgtccgagtagaagccgtagacggcggcgtatttctgccccgcataggcggtgccgccgaccacttccagcggagtggcggaggtggtgatcggattgagcgcccagccggtgggcgaggcggtggatcgcgccgcatggcacagggtaccgctgccctgggcggcgatcaccaggccttcgaccatggagttgaccgggttcacgaaggtcccgaccggattcgcgctgttgctgtcgaccaggatatcggtgctggggatggcatcctgaatcatggtcaccgtcgccgacgcatgggtcggtgtcgcgacgtaagttccggaaagccgttccgcccgctgtgctgatgccgccatatcacatcccctcatcagtgttattacgtgcctgatgctagatggtacgtctggcttcgggaaatacaattggaaaaagtcgtaaaacgagtcactaaaacgtaagacacaacctaaaagcatttgcagtatttttgtcacaaccatgatgtgaggggtgtttttggggggatggatggccggaatacctcttcaatctgccgcctctccatttggtgcggccctgcgatgtgcacaaagcgtataagaatggcgtgaaatagccatttgctgatacgtgtcgcgcaagcttggtggccggtggaagctgcgttgccgcccggcgtcaagtattcggcataactagttaaagtagagaaagtgcgttatcgcagcgtgcgtgtcgcgcccgttcgcctcaagggggcgttgcggcattctttcgcgccgaagatgccgatcccgccggacgggccggggcggaaggacaaaaaaaccccgggaaccttgcgattcccggggggcgtagggtggagctatcagagtcttagtagatatcgtgctgcgtgttgtacacgttgaacttgccggtgggggtgatcagcttcggatccttgatcacggccttcaccttgcgggtcttgtcgtccatgaccacgatcgccgacggatcggtcttgccggcccagatcgagaaccagacttcatcgcccttctcgttgtactcggcctgcaccgcgcgcttgaccgccttggtttccggcaggtcggccagcttggcgatgttgatcacctcggggcccttgtccaggttcttgatgtcgtagacggtgacggactcggccatgtccttttcggggaacagcggagcgtcggcccacaggttgttggacttgggatgggtcttgacgaacagcgaacccgcaccgtggttcttcagttcggcgacgaccttccaggcctgatccttatgcttggccggatctgtgccgatcagggtgatcacgtcggcgcccaggtgcgaggtggcccacacgggaccgaacttcggatggttgaagttggcgccgcggcccggatggggcttggacttggtgtcgaccagaccggccagcttgccgtccttggtgtcgaccacggccaccttgttggaggcgttggcggccaccaggaagtagcgcttggacgcgtcccagccaccgtcgtggaggaacttagccgactcgatggtggtctccttcaggttcttgatgtcggagtaatccaccagcttgatcaggccggtttccttgatgttgatgacccattcgggcttgatcatcgacgcgacgatcgaggccacgcggggctcggggtgatattcgccatccacggtgatgccgcgggtggagacgatcttgagcggcttgaggtcggcgccgtccatgatcacgtactggggcggccagtaggagccggccacggcgtacttgtcctcgaagcccttgaacttggaggtttccaccgaacgggcatccatgccgatcttgatggtggccaccacggcgggggtctccatccacaggtcgatcatgtccagcttgccgtcgcggccgatgacgtacacgaagcggcccgacgccgacaggcgcgagatgtgcacggcgtagccggtcttgatgatggtccagatcttcttggtatcgccgtcgatcagggcgatctcgcccgtatcgcgcagggtcaccgagaagacgttcttcaggttgaccttgttcatctgcttcttcggacggtcttccggcttcaccgtgaccttccaggaggcagtcatttccttgatgccccattccggcggaacgtcgggggtcatctggatgtaggtggccatgttcttgatttcatccttggtcaggatgtcatcgaagttcaccatgccgccatcggtgccattggtcagaatcttctcgaggcgggcttggcccagcttggtggtgttggccggctcgagattcttgccggtggcacccttgcgcagcacgccatggcagccggcgcagcgctcgaaatagatcttggcactagcttccttggcttccttgctcaaagtcgcttcctgggcgaacgcagccccactcatcgcgaacggcagcgccgtcagcaacaatgcgttccgaactcccttccacatacggcaaccctcccttacgtcaaactaaaccgtggccggaaggcccattgggcggcggccaaagcattaaggtccgggcacagtgtgccttgtcgcccctgcgggatgtgactatcgtcaaattccgtcttggaatgtcttgaaacttgtctaaaggcttaggcgccacggccgttggcggcctcgaaacaggcgcggcgcaacagatttacgtcgtcgatgcggatggcattgccggaagtatgcacgcccagtacccgcaggcggcccagcacgcgcgacaggctttcgcggcggattcccacccggctggccagcacttccttgttgaagggcagcagaacctcgacccgcccctcggtggcgggggtctgggccagcaggaattcggcgacgcgctgccagggggtcagttccttgaggtcggagatctcccccgccaggcgacggttccacttcaccagggcggccagcatgcgataggccagggcgtggtccgaatgcagcgtgtaaagaaaggcgcggcgtcccacccggatcagggtggcgtcctcgatcacctcggcgtgcagcgggaaccgtccggtggacagcatggccgcttcggcgaacgaggttccggggccgaagatctcgacgatgctttctcgcccgtcctgggtcagggcgaacagcttcaccgccccgtcgagcacgatatagaagcagtcggcctcgtccccggcgccgaacagcaaggtgctgcgccgccgcgaaatggtggcggaatcggccagcagccggttcaggacctcgggcaggatgccgtcgaacagcggcagggcggccaccacctcctgggcgttgccctggcccttgaagacgcgctggggcgtcgacagggtgcggtcgcaatcggcggttggaccctcgcaggaggggcggcaggggcacgagaccgggccgcccgacgccttcatctccacgggtccgctaggcggtgaacgcagcgcagtcgccatagatcctcaactccgccacgtcggcgatttccaccttgtcggtgcggctggccaccacacccttgtcccgcagcttggcgaaggcccgcgacagggtcgccgggtccatccccaagtgatcggccagatgccgcttttcgaagggcagccgcaccaccgcccggccggtggcctcgcccgccagggccagcaggtagctggccaggcgttcggcagtggactgcatcttcagttcggtgatctcgcgcacctgctcgcgcagatgtcccgccatggccgagatcatggcgatggccacttcgaaatgggtctccaggtaggccatcagcgtgccggccggcagggccagcagcgtcaccggcccactggcgcgggccgtcgccccgtggggcgttccggtcaacaccgcctcttcccccgccgtgtcgccagcgcacaggcgaagctggggcgaggtggcgcagggatcgatcgcgatctcgccgtccaggacgagaaacaggaattcggcgagggagtcctcggcgaagaccacggcgccatcggccaattcgagaatccggtgatcctccagcagggccgccgcgtccgcagcggagaccgccgagaacagccggcttcgcctcagcacgctaagggtatcggattgcatcttccctcccgctgcccggggtcttcagcgatcccgtccccaggcaccgattatcatctctctagattgcatgcggcgacttgatcttggttaagggtgccgtcccaatggtctgaggcggggctgatgataatagactaaagtctaggttgatgccggccagtccctgcaaagccaaggtaaattgatcaaaatcacgtcggcccccgtggccagtgattacagtccgtcacattccggggctcgcgcaggccatccggagggcacccgctccggcgggaaggagcatagcgcgggccagaccggaagtgtgtccgggacgctggcatacgcgaaaatactgccctgcgccccgatcaatcattgcccaaggtcaagtcgggcgccgatgccccatggtattcggtgaggcttggaggcgggcaactcgggtacgctggggagcgcaatggctactgaatccttgctcggaaaactgctgaggatgaaaatcctgggtgcgtctttatttggcgccgccgtgattttcgtcggcggcatcatgttctggggcgccttcaacacggcgatggaagccaccaacacgcttggcttctgtatcaactgccatgagatgaaggacaacgtctatcaggaatacgtaaagaccgtccactacaccaaccgatctggtgtgcgggcggcgtgttccgattgccacgtgcccaaggattgggtccacaagttcgttcgcaagatccaggccagcggcgaggttttccactggctgatgggctcggtcaacactcccgagaaattcgacgccaagcgcttccagctggccaagcgcgtctgggcgaccatgaagagcacggattcgcgggaatgccgcaactgccatgccttcgaccagatgaatccggcggtgcagaagcagcgcgccaagaagcagcacgaaaacgcccaggccgagggcggcacctgcatcgactgccacaagggcatcgcccacaagccggtccaccacctgctggagcaggaggaggagcagaaggctgccgaggccgccaagcagaaggccgaagccgacgccaagaagcccgccgccaccgccgccgctccggcgtcggctcccgccgccgctccggctccggccgccgcgccggtcgccggcggtgcccagttgccccccgttaccggcaaggccgtggactggagcaaggtggccgagaccaagaccgtgctgttctaccccggccagaccgccatggagtggatcctgaccggtaccgaccacggcggcacccgcgccttcaagaagggggaccgctgcttcgagtgccacagcaacgagaccgccgacatgggcgccaagatggtgtccggcgccaaggcggaaaagactccgatccccggcaagcgcgccgccatcccgctgtccgtcaaggcggcttatgacgccgacaacctgtacatgcgcttcgagttcccggccggcccccataacgaggttcccttcgccaagggcggcaagatggaccccgagaacgaggtcaaggtcgccatgatgatcgacaatggcaaggtggacatggccgcccgctcgggttgctggacctcctgccattccgacgcccgcgacatgccgaccgcgccggccgccggctccctcggcaccgccaagggcatcgacacctcgcacggctatgtcaccaaatacgtgcccgaaagccgcacccagttcgacaccaccaagcgcgacaactgggacaaggtgaagccccaggccgagctggatgccctgctggccggcggcaccttcctcgacctgacccgctggaagtcctcgggcgtgtccgagcagggctatgtcctggccgagcgcgtgctcaagcccggcaacgacgtggcctatagcggcaagaaggagggggacaagtgggtggtgaccatggtccgccgcctcaaggccacccagcccggcgaggccaatctggttgccggacagtcctacagcgtcggcttcgccgtgcatgacgacttcaccagcggccgcttccaccacgtgtccatcgacctgaagctgggcctggatgccgagggcgagatcaaggcggtcaagatgtaagcttgggcaacgggccggatgcggtatggggatatccgcatccggcccttttttcctgggagggaacggccgatggctagagttacgcgtcgtgcctcaatggccgccatgtgcggcgttctcgccatgctgtgcgccgcgcccgtccgggcggacgacccggttcgggtcagcatggacaagaatctgttcactccccagacattgaaggttcggcccggcaccacggtcgaatgggtcaacgacgaaaagcgcaccagccacagcgtgtttttcgagcaggaaggccgtccggaatccgaacgcctgtttcccggcgaaagctggaagcggaccttcgatacgccgggccgctatccctatcgctgcggtccccatcccgagatggtgggagttgtcgaggtggcgccgtgagcaacgggggattggggggaagcatgaccaatgacatgaggccgctggtccacctggtgggggcggggccgggcgatcccgacctgctgacggtcaaggcgctgcgcctgatccaatcggcggacgtggtggtctacgaccgtctggtgggcgagggcattctcgacctcattccggcggggaccgcccggatctcggtgggcaaggagaagggccgccacctgctgccccaggaccagatcaacgacctgctggtcagcctggcccgtccggggcgccgggtggtgcggctcaagggcggcgatccgtatattttcgggcgcggcggcgaggaggccatgtatctggccgcctatggcatcgccaccgaggtggtgccgggcatcaccgccgccgccggctgtgccgccgcctcgggcattccgctgacccaccgcgaggtggcgcgcagcgttcggctggttaccggccatctgagggacgaccaaagtctcgatctcgactggcagagtctggccgaccccgcctgcaccctggtggtctatatgggggtcggcaccgccggtcccctggccgaagggctgatcgccgccggcctggaccccgcgacgccggtggcggtggtggaaaaaggcaccacggcgtcccagcgcgtcttgcgcggcgtcctggccgaactggaagccgacgtggcccgctggcgggtggaaccgcccgccctgttgatcatcggcaaggtggtggccctggccgccgagcaggaggtggccgaatgggtgggggcggccgaggcctgaggtctccgtctcttgctcaacgtcaagcccttggagcgtggggagtgctattcctcgatcagcctgtgggagggccgaggatgcatttgcttggggcagtgacgggagcggtggtgtcggtgctggtggcttggcccctggcggccgcggccgaaatttcccccgggcgtcaggccaagctgcgggacatggtggatcaggattgcggctcgtgccacggcatgacccgccagggcgggctgggctcgcctttgctgcaggaagacttggtcaagctgtcggccgaagcggtggtcgagaccatcctggaaggccgccccggcacccccatgccgccctggaagttcatgctgagccgcgaagaggccgcctggatcgccgcctatttgatgggagagctgaaatgaagcgtcttgcctgtcatcccgagcgcaagcgagggatctcgtcctggcgcaccttttccggattggcatccatggcccaggcggagattcctcgcctgcggctcggaatgacacggatggccgctctgctgggtctcggcctgctctcggcctgctcgcccgccttgcgcggcaccggcgacctggggctggtggtcgagcgcgccgacggccgtctgatggtggtcgagaacagcggcaataccaagctggccagtgtggccgggctgggcgatctgtcccatgccgctttggtctattcccgcgaccagcgcttcgccttcgtgttcgggcgcgacggcggactcagcaaggtcgacatcctgaccggcgccatcgtcggccgggtgatgcaatcgggcaattccatcggcggcgccatctcccaggacggaacgctggtggcggtggccaattacacgccgggcggcatcaaggtgtttgacgccgccaccctggagccggtggccgacattcccgccatcggcggcgacggcaagcccagcaaggtgatcggcatcgccgatctgaccggcaagcgcttcatctataccctttatgacgcgggcgagatctggatcgccgatctggccgatcccaaggcgccgaaactcaccaagtacaccaatatcggcaagctgccctatgacgccctgatcaccggcgacgggcgctggtatctggccgggctgttcggcgaggacggcatcgcgctgctggatctgtggaaccccgacaagggggtacgccgcatcctcgaccattacggcaagggcaaggaggccctgccggtctacaagatgccccatctgcgcggctgggcggcggcgggggatgaaatctggctgccggccatcggccatcaccaggtgctggtggtcgacaagggacgctggacggaaaaagctcgcatcgacgtggcgggccagccggtcttcgccatggcccggcccgacgggcggcaggtctgggtcaacttcgccgttcccgattattccaaggttcaggtgatcgacacccagaccaagaaagtgatcaagaccctggagccggggctggccatcctgcacatggagttcacccccaagggcgagcgggtgtggctgtcggtccgtgactccgacaaggtggtggtctacgacaccgagaccctggagccggtggcggaactgccggccgcccggcccagcggcatcttcttcaccaaccgtgcgcataagacggggttgtgatgatcgagcgagcgcaagcgagcgcgggagcgttgagcgacccgcagcggcaccggagcgaagcgcaggtggaaagcggaggagccaagggcgcggaggcgcccgcccggcgtctgaggggctatgaaatagacgccctggaccggcgccttctcaacgagttccagcaggactttcccctggcggaccggccctatgcggtgctgggcgagcgtctggggctggacgaggacgcggtcatggaccgcctcgcccgcctcagccgtggcggcaccatcagccgggtcggcgcggtgttccggccccacgcggtgggcggctcgaccctggcggccatggcggtgcccgagcatcgcctggacgaggtggccgatctggtcaatgccttccccgaggtcaaccacaattaccagcgcgagcaccggctgaacctgtggttcgtggtgaccgcaccctcccaggcacgggtggccgaggtgctggccgagatctcccggcgcgccgggctgcgcgtcctcgacctgccgctgctggaacattttcacatcgacctgggattcgacctcaaatggacttaagcgacagcgatctcgccctggtcgcggccctggccgagggtctgcccctggtctcccatccctaccgggcagtgggggcgcaactgggcctggacgaggccgaggtcatcgcccgcatccaggccatgcgcgatggcggcatcattcgccgcttcggcatcatcgtccgccaccacgaattgggctttaaggccaatgccatggcggtgtgggccattcccgacggggtggtgagcgaggtcgggcgcgttcttggcgacgcccccgaggtgacgttgtgctatcgccggccgccccgcctgcccgactggccctataacctgttctgcatggtccacggccgtgaccgcggcgcggtggaggagtccatccaggcgctggtgcggcgcttcgacctgggggcctatccccatgcggtgctgttttccacccggcggttcaagcagaccggggcgcgctatggacggcccatcccgcgcgcggcggcggcggagtagggccatggacgacattgaccgcgccatcatcaacaccctgcagggcggctttcccatctgcgaccggccgttcgacgccgtggccgagaccttggggctgaccgggacgcaattgcggacccgcatcgggaaactgaaggccgacggcatcatctcgcgcttcggccccatgtggcacgccgagaggatgggcggtgaactgaccctgtccgccatgaaggtgccgcccgagcgcttcgacgaggtggccggcatcgtcaatgccttccccgaggtggcgcacaattacgcccgcgagcatgccctgaacatgtggttcgtggtcgccacggagaagccggggcgcaaggccgaggtgctggccgagatcgaaaccatgaccgggatcaccgttcacgacatgcccaagatccaggagttctacgtgggtctgaggttcgaggcatgacgagcgaggcgaagccgaagcgcggccgcgttgagcggcccggagcgcagcggaggaaagccaagcgagccgtaggcgagcgcccggcgattgaggggcatatgaaatgagcgaagcgaagctcgatcccatcgaccgcgccatcgtggtggccacccaggacgggctgccgttggtggacaagccctatcacgacgtggcgcgccaggtgggtgtctcgccggacgaggtgatgagccgcatggagcggatgctggccgagggcatcatccgccgcatgggagtcgtgcccaaccactacgccctgggctacaagttcaacggcatgaccgtctgggacgtggcggacgaggacatcgccgaggctgggcggcgggtgggcgagttggatttcgtcagccattgctaccaccggccgcgccacctgcccgattggccctactcgctgttcgccatgatccacgccaaggaaaaggccggcgccgatgccctggtggagcgtgtcgccgaggttctgggcgatctgtcgcgtggccacatggtgctgttctcgtcgcgcatcctcaagaagaccggccttcggctgtaggagttcgccttgttccgcgtttcccagttcatgcaagaactcgtcgcccccagcccagtggggccgcgccgcgatccgcctggcccggtggtgatctggaacctgatccgccgctgcaacctcgcctgcaagcactgctattccatctcggccgacaaggacttcgccggcgagctgtccaccgacgaggtgttcggcgtgatgaaggacctcaagtccttccgcgtgccggtgctgatcctgtcaggcggcgagccgctgctgcgccccgacatcttcgacatcgccatccgcgccaaggagatgggcttctacaccgcgctgtcgtccaacggcaccctgatcgacgatcccatcgccgaccgcatcgccgagatcggcttcaattacgtgggcatcagcatcgacggcatcgattccacccatgaccgcttccgggcgcgccagggggccttcgccgaatccatgggcggcatccgtcgctgcgtgaagaggggcatcaaggtgggcctgcgcttcaccatgaccatggacaacgccgccgaactgccccaggtggtggacctgatggagagcgaaggggtggcgaagttctacttttcccacctgaactatgccgggcgcggcaacaagaaccgcctggacgacgccaccatgcaggtgacccgcaacgccatggattatctgttcgataccgcctgggcccacgccgcggccgggcgcgagcgggaattcgtcaccggcaacaacgatgccgacggcccctatttcctctcctgggtgcagcgccatcacccggacaaggccgcccatatcgccgccaagctggtgcagtggggcggcaacgcctcgggcatcaatgtggccaacatcgacaatctgggcgaggtccaccccgacaccatgtggtggaaccacaagctgggcaatgtgcgcgaccggccgttctcggccatctggcccgatacctcggattccctgatggccggtctcaaggcgcggccccggccggtggaggggcgctgtgccgcctgtgcccatctcgacatgtgcaacggcaacacaagggtgcgggcccagcgggtgaccggcaacgcctgggcggaagacccgggctgttacctgagcgacgaggagatcggactggcatgagcattttcgacctgtcatcccgagccttgcgagggatctccgcccgctccgccgtgcgagttctgctgcggcgcgccaggatgggatccctcctcccgatggtcgtcgggatgacaattctcgccacccccaccctggcggccgaggacgcgccgcgcctctatgccgagcattgcgccgcctgtcatggcggcgaccggctgggcgccatcggcccggccctgctgccggagaatctggggcggctgcggaaggccgaggccgagaaggtcatcgcccagggccgcccggccacccagatgcccgcccatggcgacaagctgaacgccgagcagatcaaggccctggccgaatacgtctacacgccgctggcggcggtgcccgcctggggcatggcggagatcaaggcatcgcgggtgatcaacgtggacccggccagcctgccggccaagccgcaatggaataccgatcccctgaacctgttcacggtggtggagaccggcgaccatcacgtcaccatcctggacggcgagtccttcaagccgctgacccgtttccagagccgcttcgccctgcatggcggcgccaagtactcgcccgacggccgcttcgtctatctggcgtcccgcgacggctggatcaccaagtacgacctttacaccctgcagatcgtcgccgagatccgcgccggggtgaacacccgcaacgtggccgtctcccatgacgggcgcttcctgatggtcggcaacatgctgccccataccctggtggcgctcgacgcccgcgacctgacgccgctgcaggtgattccggtggtgggcgacgcgggagccacctcgcgggtctcggcggtctataccgcgccgccgcgcgccagcttcgtggtggcgctgaaggaccttcccgaggtctgggagattccctacgccgacgatgccgggccggtgatgaacggcttcgtccattcctacgagaagggccacgaggagggcatcagccccggcggccgcttccaggccatccgcatccgcattcccgacttcctcgacgacttcttcttcgaccgcacctacgagcgggccatgggggcgtcccgcgacggcaccaagggcctggtggtggatctcgacatcaagcgcaagatcgccgagatcgacctgcccggcatgccgcatctgggctcgggcatcatcttcgccaaggacggccatgattacatggcgacgccgcacctgaaggaggcggtggtcagcatcatcgacatgcagacctggaagacggtgaagcgcattcccaccctggggccgggcttcttcatgcgctcgcacgagaacaccggctatgcctggatcgacgtgtccatgggcaaggaaaaggacgccatccagatcatcgacctgtccgccatggagatcgtccggacgctgcgccccgcgccgggccgcaccaccgcccatgccgagttcgaccgttcgggcaagcacgtgctgatctcggtgatggaggccgagggcgagctgatcgtcttcgacgccgaaagcttcgaggtggtgacccgcatgcccatgaaacggccggtgggcaagtacaacgtcttcaacaagatcaattattcaagcggcaccagtcattagccggcggtgagggaacctcgtcgcccagcagggtggcgaggcaatctccccagcgccgggcgaagtcctcgctgtccagggggggcggcgccggttcgtagaccaccacatggggaatgccggggcggcggagggtgcggcggatctcatcctcgcggccacggccttcctcggcatcgccgtccaggaccatcaccccgaggcgggtggggtcctgggtcttgatcacgtccatgaacttgtagtcgtgccactggcggccatggcgggccgtctcggcgctgaccgtggcgtccagggcgatcaccgcatggatgccgccgccatccaccggcgtcgaccacgaggaattggcgatcagcgacacccaggcgccgaaggagcgcccggccagcaccacccgggaatagccttcgccccgcgccgcccgggcctggtcgaacagggccttgccgaaatcgtgctcgcggcggaaatccaccggcacccgattgatgcggatcgtccagccctggtcgcggaagcgggccagcaccgggggaggggcctcggggacgcccgcgccgaccgtgtagaggatcaggcgattctcggccgcggccgggctggcatggaggccgcatagcaagggcagggcggccaggattggaaaaaggcggatcatggatgcaccatgacacggccggctgacgccagcctatcgcccgcatccagtcggggcaggtgacgtttctccaccattctgatacagatggacgattcactggaggggcggacgtggggttttcgttcgacgagaaggcgatttcccgggttcatctcatcggcacggtccttgtggtcggttgcctggtgctggggctgggattctttttcgtccgccagatcaccgccgaagccgaagacgccattcgcgccctggaagtccaggaactgcagaagagccaggacctgctggtccagcaggtcgagaccgccaagggcttcctgaccaccttgcgcctgcagaccgaagaggtgctcaagcacgaaatccgcgagcaggtggacgaggcccatgccctggcccaggccatctacgaccaggaaaaggggcggcgttccgaagaggacatcaagcgcctgatcaccgaggccctgcgtccgctgcgctttttcgacggcaaggggtatttcttcatcgacggcatggacgggtcctgcgtgctgctgcccatcgggccgtcgcgggaaggctcgtccctgctgaacaaccgcgacgataccggccattacatcatgcgcggcctgatcgaggcggcgcgcaagccggtgggcgagggctattcccgatatcgctggtatgcgcccggagaccccgagaagatggccgccaagatcgcctatgtccgccatttcgcccccttcgactggctgatcggcaccgggcagtacgtggccgaagtggaagaccggctgaaggtttccgccctggaccgaattcggctgttccgcttcggccgggacgcgtcgggctatatcgtggtgatcgatgaccgcgagcgcatcctggtgtcgccgtcgcggccgtggaacgagggcaagaccgtgtcggacctggagccggagcagcggaacgccgcccggcccatcgtcgagcaggggcgcaagggggacgggttcattcgctatgactgggccagggagggcggaagcggcgcggtttcgaccaagctgtcctacgtctcgcggctggaggactggaactggaccctggcggcgggggtgtatctcgacgagatttccgtaaagagtgacgaacgccgggcggcgctggcccgcagcatcgaggacaagcgcaagctgacactggcggccctggccatcggcctgggcgtcgccctggccgccggcatcttcttctcgcgtctggtggcccgtctggtcgcccgctacaagcttgacctcacccatcagaacgaccagttgcgccgatccgcccgggacctgttcctgatcaactccatcgtggattcctcggccgaactggcctttctggccgatggcgagtggaacctgatctacgccaatccgttcgcgctggaaaagctcggctggtcgctggaccagatgtcgggtcgccggctggacgccatcgccgattccctggcggtcccggccgctgatggcgaccgccattcctggcgcttcgaggccgccctgccgactcatgacggccgtgccctgcccgtggaggtcctggcccgcgacctcctgcacgagggcgtgctctaccacgtggctctggcccgcgacattaccgagcggcagcgctgggaggccgatctgtgcgccaagaccgcccagctcgagcattccaatgccgatctcgaacagttcgcctatgtggccagccatgacctgcgcgagcccttgcgcatggtctccagctacctctccctgctggagcggcgctatggccagcttctcgattccgacgggctcgaattcctgggctttgccaaggatggggcgcagcgtctggaccgcttggttctcgacctgctggaattctcgcgcatcgaccggcgcggttcgcccctggcgcccatgccggtccgcccagcggtggatgtggccgcccgcaacctgtcggtggccatggcggagggcggcgcgacgcttgtcctggaggacgccctggatcgggcggtcgttctcggcgacagcggccagatcacccggctgctgcagaacctgatcggcaacgccatcaagtaccgctcggacgggcggccgccccggatcgtcatcggctgtcgccgcgatggcgcgtgctgggagctgtcggtcagcgacaacggaatcgggatcgagccccagtatttcgagcgcatcttcggcatcttccagcgcctgcacacccgcgacaggttcgagggcaccggcatcggcctggccatcgccaagaagatcgtcgaacgccacggcgggcggatctgggtcgacagccggcccggcgagggaagttccttccacttcaccctgccggcggcggccgcctgacttcaggcctgggccgtcaccgccgcctgttcggccacctgatcgggaatggtgaagaagaaggtggagccctggcccggggtggaggtcaggcacatgcggccgccatggctttccacgatgcgcttgcagatggccaggccaatgccggtgccggaataggccgcggtggtgtggaggcggcggaacacctcgaagacgtagtcatggtactgcgcgtcgatgccgatgccgttgtcggccaccgcgaagcgccaggccgcgccgtcccgctcggcgctgatccgcacctcggggacggcattctcggcgccgtatttgagggcattgcccagcaggttgtggaagacctgatacaattgtccccggtcggcggacaggcttggcaacgggccgatttccagccgggctcccttctgctcgatgcgcggccgcaggctctggaccacggactcgaccagttcggcgcaatccacggtggccaccgtcaggccggcgccgccggcccggctgtattccagcaggtcgcgcaccagattggacatgcgttgcgcctcggcgatgatgaagcgcaggtagtccttaccctcgccctccagatcgaccgcgtatttgcgctcgagcaactgggagaagctgaccaggccgcgcaccggctcctgcaggtcgtgggcggccacataggcgaagcgttccagttcggcattggtccgcgacagttcggcgatcacctgctgcaggtcgctttccgcccgagtacgttcctggatttcatgctgcaattcgtcgtggcggtcgcgcaaatcctgcgccgcaaggtgcaactggcggccgatgttgtcataggcccagcgcagacggtcgatctcgtcgccattctcgggaaagcccaggcgttcgtcataaattgacgcctgcgtcatcagggattccggcaccagattgccgacgctgcgggccagttcctcgacccgccgggtgacgaggtggctgaagatcacgtacatgaacgccgcgaccaggaaggtctttatcgcgttgctggccaagatggtgatggcctggctcagcaggcggtcatagatgccgtccaggctggccgtgacgtccagggtggcgatccgctgcgtctcgccgcggatttcgcgcgaaagggggtattggcggctgagaaggcgcccggacttgatcgtgcccgacgaccaggtgttgcggctgtccaccgtggtgatcaccacgtgctccacatggggaagccgggtcagggaatccagggccagggtgatctgttgctcgtcaagagtccagacgctgcccgtaatgggcggcaggaagatcctgacctcctccagttgatcgtccatgtcggcacgttgttgccggtattcgtggataagctgataggcggtcgccaataaggccagaaaggagctgaatgtgacgatcagaacgatcaggcggcggccgatcctgttttcccgtcccttcttgcgcaacagcatcatcatcatgatgcgggacagcctaaacgcatctctgaagggatacgagcccaaagcattcgtatggactactttaggtttggctttggaacgccttcgatggtcaatcccgcggcaatggtttccagccgactcatgagtgcctcggcgtcggggaaggtccggttgaggaccagatgcacgtcgaggcggtcgatgacgtcgtattccaggtcgcggatcggccgctccgccaggacctcctgggccggtccggcataatccagcaggtagtcggctcgcccgcgctccagcatggcaaaggccgattcatggctgacggttccgttgttgccgatgcggttggccgggtccttgatgaaaggcaggaggctgccgtaagtatagccgtggacggtgatcacctccttgccggccagatcctccctggaggtgatggggcgtttgcccttgcgatggtagacccgcaattcggtgccggccactggccgcttgctgatcaggcagcacttgtccagcaccgttcccttcaccaggatggaaaagtcggtctggccatcgcgcagatgctcgaacaggcgcgccgccggcagcccgcgcgcccgccagggaatgcccgcctgctggaacaggggcgcggccaggcgcagcagcggattgtcgggctcgcctcgggcatctaggcgggtggtccacaccgactggtcaggataggagtattcaaggactcgcggctctgccgcggcggcggcggatgcccccgccaggagaaggattagtcccgcaaagaaacgggttggcctgcccatggtcatcagccgtctccaacccatcagtttccccatccgtggatgctagccgaaagtcgtggggttctcaatccggcaggaagggcgtgggcgacatatgtttgccgtggccttctttttccctcggccctatcctttggcgagggctgcgaggcaggaggggcggtatgtccattgaccaggaacttcatgcagggctcgagcccggcctgcgtttcgccatgctgatcggccccgatggcgctgtccgcgacctgcgctggtcggaagtggaaaagtggcggcccgtcgatggctttctctgggtccatctcgaacgcgacgagcccacggccaagacctggctgtgcgagcattccggcgtggaccccctggtggccatggccctgaccgccgaggaatcccggccccgggtcgaggacgtgggcgattccctgatggtggtgctgcgcggcgtcaacaaggcgcgccacggcgagcgggaggaggtggccgaaaccgagctggtgcccatccatatctggatcgaggccgaccgctgcatttccttgcgtgacaaggatcactccctcaacgcgctacgcgacctgcggctggccatgatgatgggcaaggggccgcgcaccgccggggcgttgctggcccgcatcgccgagaaggtggtggaccatctgggcatcctgaccgacgagatcgaggacggcatctcggatctggaggaccgcatcggcgaggggctggccggcaccgacctgcgcgaggacatcgcctcggcccggcgcaaggtggtgcagttgcgccgctatctggcgccccagcgcgatgccctttaccgcctgcgccatgacgatgccagctggctcgaccccgaggccaagatgcgcctgcgcgaggtcaatgaccgtctgatccgccatatcgaggacctggacgaaatgcgccagcgcgccaccatcctgcacgaggattttaccaacctggtggccgagcgcgccgcccaatcctccaaccgcctgaccgccctggccgccatggtgctgccgcccagcctgctggccggcatgatgggaaccaatatcggcggcattcctggatcgcaggagccgttggcttttctggtcctgtgcggcgttgtgctgggcatgatgccggtcacgtatctggtcctgaaatggattaagtggttgtagtctttcgggctcgcaataattcgtttctttccctgggctcgggatttcgccaatctacgggtccatcgtggggatggaccgaaatgctgcgcgggggcagatgaccaaggtcgatgacggtggggtcggcgggcggggggacgacgagtccgcgccgcgtcgcaagggcaagggcggggccggtctgggccagccgcaggaggcttatgtcgccttcgccttcgccgccgccgacctgctgatggaggccgaccacgccgggcgcatcatcttcgccatcggcgcctccatgtccctggtggggcgtccggcccgcctgctggccaccatgacccttcccgacctgatccgtcccgaggaccagtcccgcgcccggaacgccctgaagcgcatggccaagggcgatcgggtccggcatgtgctgctgcatgtccacctgccggcggggggcagcacgccggtggcgctgtcgggctatccccatcccgatcaccaggggcgcctgctgctggtgctgacccattcgggcaccctgatgtcgcccaccgtccgcaacccggagacgggattgctggggcgggaaggcttcgaggccctggccggcgacctgatcaaggaaagcgccaaggacggcgatgaatcctatcgcatgaccctgctggatctgccggaactggcggaactgcgcagcaaggtcggcgccgaggccaccgccgacttcatcgcgcgcttcaccgattacctgaagcagtgttcggtggggggcggggccgccgccgatctgggcaacagcaagtacggactgattcacggccccgaggtcagcgccgccgagatcgagaccgccatcagcggtctggcccaatcggtgatgggctcgtccctgagcgcggattccacctcgctggccatcgacggcggcggcatctcggcccaggaggccaccagcgcgctgatctacaccttgaaccgcttcaccaccgacagcgacgccaccatccacgaattgtcggccatggcgcgtccgaccctgtcgcagaccgtggccaagatgcgcgaggtcaagcagaccatcggcaggggcgagttccagctttatttccagcccatcgtcgacttgtggagcaacgcggtccatcacttcgagtgcctggtccgcttcggcgacagcggcaactcgccctacagcaccgtggtgttcgccgaggatacaggtctggtgggcgaactggacctggcgatctgcgcccgcgccatcgccttcatgcgcgagggcgtgggggccgagccctccctgcgcttcgccgtcaacctgtcgggccggtccctgtccagccccagcatggcggcgcgcctgcttcagatgatccacggcgcctcggacctgcgcgggcggctgctgttcgaactgacggaaagctcggccatctccgatctggtggcggccaatgccgtcatccaggaaattcgtgggcgcggccatccggtgggcatcgacgatttcggtgccggagcagcggcgttccactatctgcggggccttaaggtcgaccacgtcaagatcgacggatcatatgtgcgcgatgccgccgccaagggcgattcgctgcctttcctgcgggccattacccagttgtgtcgcgagctgcgcgtcgccaccatcgccgagcacatcgaggatgaggccaccgccaatctgctgcgcgtctacaacgtgcgctatggccagggctattacttcggcaagcccatgaagcccccggcgccgggaccggcgggcaaggccccctggacgacgcccgtgacccagtggcgcaacggcctgctgttcttcggcaacggggcgccgccgtccggtggctgatgcgggcgcccgggggggcacctgtcacgacttgcatgttgaatttcacttcctctagccttattgagcactaaccaaagtttgggagtgaatcgtgccggcttggacggaaagcctgagtgtcggggtccccgtgctcgatgaacaccatcgtcacctgtttcacctgctggccacgctggacggcatggccggcggcagtgtgggccaggatgccgtccggagcgtgttcgacgacctgaacggctacatcgcctaccacttcgccgaggaagaggccatgatggcgcgggccgacttccccttcctggaattgcaccgccattcccaccagaccatcgccatgcgggtggccgacatgtccgccgagctgtccatggccaatgtggagcgggtgatccgcgagcttcacgactttcttgtcggctggctggtgcatcacatcgaaatcgaggatttcgagtatcggccgtttctatccggcgataagtaatactgcgtgaatcaggtgccgtcgggggctctccggcctggcaattgtgcggtgcacacaattgcctcaagtacctcttcgcacatgcaaaaatattattgcatatgtccccttgattgatatttcggggctcgtctgctatgttttcccacaaaagaaaggcaagtattccagggaagacgtggaggtccgatggcgcccctgacgcaggagcatgagaccggggttccgggcatcgatgccgggaacgaggggttgcgcttcctgctggggcgggtgttccagccgggcgtcgagtgccgtcgcggcatggccgggcatggcgactgcgatttcagccgttgcacccgcatcgaggcgatcatgcgctatgtggggcgcaacttcgcctcccaggaacaggtgatgacggaatccgattatcccgatgcccgccggcacctggacgaccacgccgggctgctggaccatctgggggtgatgctgcacgcccgggtctgcgccgagaaggatgccgccaaggttcacgacctcatcgcccactgggtggccgagcatacccagcgctgcgaccgtccgctgggccgctgggcggtgacgcggcgggtgctggagcccaagaggtagtcctcggccgttgtcaccgccgggcggcatcgctactctgccggccatgagcgaacctgcccctccggcggccgaatcccccctcgatcccgaacagcgcctggccgccgaggccgaggcggactccgtgctggtcctggccgggccgggaaccggcaagaccaccaccctggtcgggcgctacgtccatctgctggagcagggcgcggcgccggcccgcatcttcgtctccaccttcacggcgcgggccgccgaggaactgcggggccgcatcggcgcccggctggagacgcggggcggagacttcgacgccgagcgctttcgccgcatgcccatcggcaccctgcatggcatggcgcttcgcctgctgcagcgccatccgccgcccggctgtccccgctttcgggtgttcgacgagcaggcctgttcgcgggtgatcgcccgccatcgcctttatctcggcgacgacgtgcgcaagcccaccgacgtgttcggcgcctacaaggaccggctgatgagcccggcggcggcgctggccgaggccaaggtcaggaacgacgccaccctggttgaggcggccgaggcctatggccgctaccagcgcgccctggccgaggaggggggcttcgatttcggcgacctgatcatggaactggtgcgcgggctggaggaggacgaggcctaccgggcgcgcatcgccggcttcttcgaccatctgctcatcgacgaataccaggacatcaacccggcccaggagcgcatgctgcgcctgctgcggtccgagggggcgcggctgtgggcggtgggcgacgacgaccagtgcctgtacgcctggcggtccgccgaccccgcctttatcctgggcttcgagacggcgtggcccgacccggcgctgttccgcctgtcgcgcaactaccgcagctcggccaccatcgtcaacgctgccggggcgctgatcggcgccaaccgccgccgccacgccaaggatcaggtgccgcacagcgcgtcccgtctggcgttgaccatcgccggcctggacgacgacgaggacgaagccgattacgtgctgcgcgtggtcaagggcctgtccggccgaggcatgccctggaatgaaatggcggtgctctatcgcgccggccatgtggggtcgcgcatccagatcaggctggccgaggccgggattcccctggtggtccggggggcgggcgagttctggcaactggggccggtgcgcctgaccgccgggctggcccgcctgctgtccaatccccaggacatggatgcccgggccatgctgggccacggcaagcgggtcgacaagctgctgcagcaggctcccgagaagatcgacgccgacgttccctggccggccttgtgccgtcaggtggggcgcctggtctcggccaccgcccggccgccgggcgaagaggggctgcaatggcgcgacctggccttcaccgccgccgacctggccgccgagtgcgggactgtggccgccttcatcgccctgatggaggagcagcgccggtcgctgcgccgggccgagagcggcggtgacgccgtggtgctgtccaccatccacggggccaagggactggagtggtcggcggtggtggtggccggctgcgaggccgacctgatgccccacgagtcctcgcccgatctggaggaggagcgccgcctgatgtatgtggccgccaccagggccaagcgctggctggtgctgtccttcgccgccgaacggcgcaaggcggtcgcgccgtcaccctatatcgccgaaatgctgagcggtctcgacgaggatcagatccgttaccacgacccgcagagccgggcgcgtctgcacgccggcccgccccagccggtcaaggccgacgggccgctccggctgcggccggaactgaaggtttcgtcaggcatgcgaaagggccgcgcaccgtccaaacggactcgcttctagggccttggtcaagggtagggagtgtttgattttcgcttgtgaacagggcatcctccccttgcgctgtccaaggtccgggggggggaggggagcaagtcccgcccacgtctgggaggacgatgcggaggcaatcgtgccgattgcccccgctttttgctgcgacccgtccgcgcccaggcgccggccgggcgtccgggcggatggcgcttggtgaatttcacgaaggtcagggcggactcatgggcgacaaaaacatgaccagaggcgagaccgaggctgcggtaccggggatgggtgccgtcgaggccgaggctaaggaaccggcagcccccgtggcgccgcccctggccattcttcgccctgaaccccgaccgttgggtggcgatgccggcagtcccggcaacaagacgacccagatggtggccctgctggtcaccgtcgcctggatcggcctgtgcggctactgggccaacacttccatcggctggggcaacctgctgttcatgcagccgcaggagatcggcggcatggtcggcgccgccttcctgccgctggccttcctctggctgctggtcgcctatttcgaccggggccgcgaactgcgctccctgtcggtggatatgcgcgagcagctttcccgcctgacctatcccgccgagggcgccgagtcccgggtgacgcgtatcgccgacgccctgcgcacccaggcccgggaactgaccgaggcctcgtccgaggccgccgccaagggcgatgcggttcgccagatgatggcgtcgcagatcgaagccatgaccggcgtggtcggtcgcgtcaacgatgaggcccagaccgccgtcgaggccctgcgcaaggaggtcgaccgcctgacccaggccgccgacggcgccaccgcccgggcccgtgaggtcgagaccctgctgcgcatgcagacccaggacctgaccaccgttaccgacacctcggcgcaccgcatccgcgagttcggcgagctattgcgcggtcagatcgagagcatcgattccacctccgcccgcgccgcgtcccgtgccgacacggtggccgagcaggtgcggacccaggccgaatccctggaccatgtctcccaggcggcggtggcccgcgccgagcaggtggtcgccatgttcgagcgccagagcagccagttgggcagctcggccgagcaggccaccacccgcaccgaagtggtcgccaattccctggccgagcgggtcgaagcgctggaaagcctgttcacccgccagaacaccgatctggatcaggccgccgaacggctggccgagcagaccagccgcatctcggcctcgctgcagcagcaggccaccggcctcgatcagatcaccgagcgcgtgctgtcgcgcgtcaagatcgtcgaggaagccctcggcgtgcaatcgcgtgagctgggctcggcctcggatcaggccatgggccgcttccgcgagatcgaagagacgctgggccgccacaccgagaatctgcgcgtcgccgccgatgacgcctccagccaattgggcgccgtgggcgaggtgttcgtccagcgtcgcgacgacgtggacgccgccgccgagcgggccatggcccgggtgcgcgaggtgggcgaggccttccagggccagacccgcgccgtcgccgccgcttccgaccagatgaccgcgcggggccgcgaggtctcggagacgctgcgtctttacatcgaggatctcaacaagggagcggaaaagtccgcggcccaggccgagaacatccgcacctcgctcaggaagcaggccgacgaactggccgatgccgccaatgtggtgtccacccagtccaagctgtccgaagcctccctgaaccagcagtcgcgccatctgatcgccacctcggatcaggtgatggccaaggtcaagaccattgccgacaccctgcgccagggcaccaacgacctgatcgccacctcgtccaaggtcggcgtcgagctggacgcggtgggcgagaccctgcgccagcgcaccaccgacgtctccgccgccgccgtcaaggccatctcggattccggcggcgtcgcggaactgctggagaagcgctccgagcagcttcagcacgtctccgaccagttgggctcgcgggtgcgcgccgccaccgaggtgctgcgcaagcagaccgagcaggtggtggccagcgccgatcaggccgaggcctcggtcagcgcggtgggcgaggcgctgcgcgtccaggcccagtccctggcccgcgtcgccgacgattcgtcggatgtgctcaaggccttcggctcggccatccagcagaacgccgtgcagctgggcgaagccgcccagcaggtcttcgcccagtcccagacggcgggcgatgccctgcgctccatcagccgcgatttcgaggaggcctccaacaagacggcggcccaggtcaccgccgccggcgacatgctgcgcgccggcatccgtgagctgaccgcctcggcggagcggatcaccgcccaggtgcgctcggccggcgacggcctgcgccgccacgccagcgagatgcaggaaaccaccgaacggaccggcgccaagctggaagccgccttcgagatggtgcgcaccaagtccaatgatctgggcatcaccggcgaccgtctgtcccagcaggcggaaagcttctccaacagcttctcgcgtcaggtggaggaactggtcaacgcctccaagctggccgagatccgcggctcgcaactggaagaaaagcgcgcccagctctcggttgagcacttcttgcagaacgccgccttcatcgtcgagaagctgcagtcgctctcggtggatatcggccgcatcttcaacgccaatatcgacgagaaggcgtggcgcgagttccatgccggcgaccagtccatcttcgtgcgcaagattctcaagaatctcgacaagcaccagatggcctccatcaagaacaagttcgaggacgacggcgatttccgcgaatacgtcacccgttatctggcggagttcgaggccctgctcaatcaggcccgcaattccgatcaccaggacgtgttgaccggcaccttcacctcgtccgaggtgggcaagctgtacctggtcctggcccgctcgctgggccgcctggaatagggtctgccggaaggctgaatggaaacggcgccggagtgatccggcgccgtttcttcttgtccatccggtgggcttccgcccactcccgatcggggtgaaccccaaatgggtccgggcaatcgcccggtggcttatcccagcaccgcccgcaattgggccagacgcgtctccagcgcctccggagtatagggcgttgccggaacggcgccccacaccggcttgggccaggcggcatcgtcggtgtcgcgggcgatgacgtgcacgtgcaattgcgccaccacattgcccaaggcggcgacgttgatacggtgaggggccagcgcctggcggagcgccgtcgaggcgcgggcgatttcgtcgagcagagcgtgctggtcggcgggatccaggtcggtgatctcgaccacgccggcccggcgggggaccagcagtagccagggataggtgctgtcgttcatgagcagcacccggcagaggggccattcggtcaccggaacggtgtcagcggcgattctttggtgcagttcaaacatgcatgggttcttcacgttgcgccggaggtagtgttcaaggtatcaggaagcgccgctttcgaaagggctttccccatgcgtcgcaaccgcaccaatccgtttcaccagctgtttacgagtctgggcctgctgctgctggccctggccctgggggttggcggattggagctgatctccggctgggtggtcaagctgatccgcgacaaacgtccggccttttctgcggctttgtccgacgacgacctgcgcaagctctacaatgccgaggacgtggcgccctatcgccagatcctcaaggagagctggcgccagttcgacacggtctacacccccttcgtggaataccgcacccgggagaccgaggggaagtatctgaacgtcaccgaggacggtatccgcgccaatggggccggccgtcccgatccgcgggccgagggcgtcaaggtcttcgtgttcggcggctcgaccaccctgggggccggggtgcccgacgacgagaccattcctgcctatctggaaaaagcgctgggcggcgccggtcggggtgacgccaaggtgttcaatttcggcaccgtgtcctatcactcgacccaggagcgcatcgcgctggaacgcctgctgacggcgggaatcaagccggatgtggcggtgttcatcgatggcgacgccgatttctaccactgcgccgttcccgacagcagcgcctggaacgagcgcctgacccagctgacccgcgcccgcgcccgccagcccatgtggcgcgagcttgccgcccggtcccatgtgctgcagctgatcggccatctcagcggcgacaagtcggtgctggtgcgcgaatgggggcggttctgcgagagcgatgccgaggtcgatgcggtgatccgccgtctcgacaccaaccgccgcatggtcgacgccctggccgagcggctggggttcaaggtgctgttcgtgcagcagccggtgccgaccttcgcctacgacaaccgcaagcgccccttcccggtgaaggaggagctgatgggctatcacatgaacgcggcgcgcggctatccgcgtctggccgaaatgaaggcggccgggcaattgtgggacaagggcgtgctgtggctggccgaactggagccccaggacggcaacgcctatatcgacgcggtgcactattcgcccgccttcaacaaggccatcggcgagaggatcgccgccgtgctggtcgagggcggtgccctggccgcccgatgagccggaggccggcgtcataaccctgggtcgagtatcgcgccgcggcagttccgcaacataaaatatctccatggcgcatcggtgccctgcaattccttttgttgcacggggcggtccgggcggacagaatgtcgcccaacaccgggggcgggagccttggggcgcgggatcgtctcgaggggtcgtcgaacaagataacgtctgggaggacgcatggtttcggccaagccgggcaagaccattgcagcaacggcatccgcggggatggccggagcatgggacgacaccgcattccattggagcgatgcgcagaccgaactgaccggggcgcccgacggcggcctgaacatcgggcccgtctgtgccgaccgccaggttgggcttgggcggggcgaggccgttgccatccgctggcttggccgccggcaggaccggcaggacgtcacctatggccagctggccgagcaatcggggcggatcgcccgcgtgctggccgatttgggcctgcagccgggcgagaccgtcgccgtgctgctgggacggacgcccgacctgtacagcgccgcgctgggaatctggaaggcgggcggaatctattgcccgctgttcgcggcgttcggacccgggccgatcaaggcgcgcctcgacctgggcaaggccgccgtgctgatcacctcggacgacctttacgcccgtaaggtggtggcatcgcgctccgccttgcctgatctgcgccacgtgctggtggttgggggggaggagggggcgacgcccgagggctgcgccgacctgcgctccctggcctctgccgcccagcccatggaggcggtgccgaccgctcccgaggcgccggccttcctgcatttcaccagcgggaccaccggtacccccaagggcgtgctgcatccccaccgggcggtgctcgcccatctggtcaccgggcgcaaggtgttcggcctgagcgattccgacgtgttctggtgcaccgccgatcccggttgggtaaccagtacctcctacggcattatcgcgccgctggcctgcggcgccaccctgatcgccgacgaggccgaactggaaccccgccgctggtacggcatcctgcatgacgaggaagtgaccgcctggtacaccacgcccacggccatccgcaccatgatgcgctatggcgcggccctggcccgctcgtaccgccagaactcgctgcgggtggcggctagcgtgggcgagccccttaacgccgaggcggtgatgtgggggcaaaaggccctgggcgttcctttcctcgacacctggtggcagaccgagaccggcgccatcaccatcgccaacggccccggcaccgaccgccgtccgggcagcatgggccgccccctgccgggggtcgaggcgcggatcatgcgctgcgaggggggaactcccaaggcggtggatggcgtcgacgcggtgggagagctggccatccgcacctgctggccctccatgttctccggcgccctgggcgaggagacccgctatggcgacagcttccgcgacggctggtacttcaccggcgatctggtcaagcgggacaaggatggcttcatctggttcgtcggccgcgccgatgacatgatcaagtgcggcggcctgcagatcggtcccttcgaggtggagggcagcctgatggaccatccggcggtggccgagatcggcgtggtgggcaagcccgacatgctggtgcgcgaagtgccggtggccttcgtctcgctcaatcccggcttcgaagccggcgatgccctgcgggccgaattgctgtcctatgcccgccaggaattgggggccggcatggcgccgcgtgaaatccatttcgtcgaggaactgcccaagaccaattccggcaagatcatgcgccgggtgctcaaggccaaggccatgggcgagcccgatggtggggatatcctcaataccctgccgccctgtccggggcgctacgacgacgagtgatcaacgaaaacggggccgaaaggccccgtttcagtgtccggcccgaaggggcagaccaaatttgagtggccaaccggggcttggcatccggcgcccattgcgggcgcggccaagcaaactgagggtttgtgtccgccgagagaaagatacgatgtcagccccgtttgccgcaggggcatccgcccgatccgccgccgcatccgcccttgctctcatccaccagttcgcgaacggtggacacgcatttgccgcaacggggcttggagtcgaagtggcggaacaccgcctgcgggctgccggcgccttcggtgaccgcggcgcggacctggcggtcggtgaagccgtgacagagacaaacgtacatcggtgcctcccttctactgttcgctgctggcgcaggtggtggtggagccgtccgcctcgttcacttcccaggcgatggcttgcaacgtgccggcgcacaggcagagcagcagggtgaagaccaggaggcgaagcgagatcatgtggtgctccatggcatgatccatgacgtaatgcacatgataatgactcgcatctctaatgccaacagttattttgggtgatacgcaatcgcaacaacccgatcagggctggcgcgagatgagcgcccggctgagcagggcgggatcgtcccaggggacgtcgctgaaatggtgacgaagatgcgggcttagcgcgtcgcgccaccattcatggggaaacagggcaaccacgtcatgtcccgggtcgagctgtggggaacaggagtttccgctcaggccggcatgcagggctttggcaagatcgtgaccgaaggccgcccccagatggccggcgatggtcagtcgcgggttcatctccaggaggtggggcgttccggtggcggcctcgatcatgaagtcgaagccgccgaagccgctgaatccgaaatgggccaccagctttctcgccgtcccggcgattcccggatgatccagtcgccggatcacgcagcttgggccgcattccccggcggtttcctcggtggaatagctgaagctgtcgagcaccacgccgtctagggccaccagggcgatggaggccgggcggccccggatatgctcctgcaccatgatggaccgctggccgacataggcgggcagggtcagggaccgcaaccgggccagggcggcggcggcgctttccccgtcggtgcaggcccgcacggtcagcccggccatccccaccgacatcttgagcagcaaggggtagccgtgccgggtcgcgaagtcctggaaatcctcggccggcgcctgtggcgggtgcgcaatgtccagacgcgccgcctcctccagggtgcgggtcttgtccgtcaccacctggtggaagcgcggatcgccgcaagagcggcgcaccagctggcgcaacgtctcgggagttccgggacggtccatgccgcgcagcaggtggacggcgaactcgtcgccaggaatgaccagatggggctcccaggcggcaacggcatcggccagttgcccctcgagatcggggccttgaatgacatagcgctcgcagacgaatcgggtcagcgccagccaactgcgcgggggacagaacgccgccacctcgaagccggccgccaccagttgcgacggcaggcgcgcgatgctccaccaatccggtgcgacggtcatggccaggacccggacgcccccgcctcccgaactcattgggccgggagcgaagcggccctgctcggccagcctggtcttggcggcatcggtcctgtcggtgtgctctgtggtcattgcgcttcagcctaacccacgatcccggccgggcgaaccccttaacccgtcctccaggactctggcggacaagcatgggctcgtgtagcttcgccgttcctatcgtgtgaagggtgaccgatgaccttcgaacaggggctggccttcaccatcctggtcgccactatcttgatgttcgctctcgacaagctgcgctacgacctcgtggcgctgctgtcgctgtcggcgggcgttctggccgggctggtgccgccggacaaggcgttccacggcttttccgacccggtggtggtggtggtggccgccgccctggtggtcagcgcaggcatcgagcggtccggcatcatcgaacgcctgatgaagccgctttcggcgctgaaatcccccgatgccctgatcggcaccttggtggcgctggtgatggtgctgtcggccttcatgaagaatatcggcgccctggccatcttcattcccctgtccgtccggctggcgcgggcggggggcattccggtctcgcagatcctgatgccgttgtcgttcgcctcgctgctgggcggcgtgatgaccctgatcggcacctcgcccaacatcatcgtgtcgagggtgcgcctggaactgaccggcaaggccttcaccatgttcgacttcacgccggtgggggtgggcatctgtctggccggcatcggctttctgaccttcgcctggcgggtgctgccccgcgaccgccagggcagttccggggacaagggcttccgcatcgaggactatctggccgaggtgcgcatcgaggcccactcgccgctgatcggcgccacggtggccgatctcgaacaactgttttcgggcggcgcggtgacggtggcggccatcatccgcgatcaagggcaccgctacgtccccggcgggcattgggaattctcggaaagcgacgtgctggtgctggagggcgaccccatggccctgaagccgctgctggaccaggcggggctggtgctgatgggcggcggcggcctagggagcgaggacaccacggtgatggaggcggtggtgatgcccaactcgcccctggtcggcagttccgccgtgcgcagtgccatgcggcggcgccacggcatggccctgctggccatcagccggggcgggcggcacatgatcgagcggctgcgccagaccgagttcatggccggcgacgtgctggtggtggagggcaacggcgaggcgctgcccggcaccctggcgcagttgggttgcctgccgctgggccagaaggccatgccggcctcgggcaagtcggcctggctgccggtggggatcgcctttgccgccatgctgtccgtggcggtgggcgtgatgccggtggcgccggccttcttcctggcggcggtggccatggtgctgctgggctgtctgccgctgcgcggcgcctacgaggccattcactggccgatcatcatcctgctgggcgccctgatccccatcagcgattccatgaagagcaccggagcctcggacctgctggccggctggctggccctggcagcctcgcaggtgccggtgcccatggcgctggggctggtgctgctggcctctatgctgctggcgccctttctgcaccatgcggccaccgtgctgctgatggggccggtggcggcgggcatggcggtcaagctgggcctggccgtcgatcccttcctgatggcggtggcattgggcgcggccagtgacttcctcacccccatcgggcaccagtgcaacaccctggtgatgggtgtcggcggctatcgcttcggggattactggcgcctgggattgccgctcagcgtcatcgtgctggtgtcgggcaccctgctgatcctgaccttctggccgatttaaccccgagcgcccgttctgggcgcgagagccgatttaatttgacttgtgcggtgcaaaagcgcagggtccgccggtccggacgattcgcgtccggcttgctcgcgggcagcgcgcagatggcatggtcccccgatggatcgcctttccgccccgagccttctttcccttgcccatagcttcctggccgcgcgtccgggaggagcccgacgaagaccgcatcccgcggcgttcgtcccgccgtccgtccccgccccgcgtgggccgagggatgacggtttgttgatgaaagagaccttatgaccgttctgttttccgaactcggcctggccgaacccctgttgaaggcgcttgaagccgagggctacaccactccgaccccgattcaggaacaaagcattccccatctgctccagggcagcgacgttctgggcctggcccagaccggcaccggcaagaccgccagcttcgccctgccgctgctgcagcgcctggaccagttcaagaagcgcgccatgcccaagagctgccgcatcctggtgctgacccccacccgcgaactggcggtgcaggtgggtcagagcttcaagacctatggctgccattaccggctgcgccacgcgctggtgttcggcggcgtcggcatggtgccgcagatcaagaccatggcgggcggcgtcgatgtgctggtcgccacccccggccgtctgctcgacctgatcgagcagggcgccatccgtctggactcggtcgaggcgctggtgctcgacgaggccgaccgcatgctcgacatgggcttcatccagcccatccgcaagatcgtcgccctggtgcccaagcagcgccagaccgtgctgttctcggccaccatgcccgattccatcgtcggcctggccaattccgtgctgcacactcccgtccgcgtcgaggtgaccccggtgtcctccaccgtggacaagatcgaccagaaggtgctgttcgtcgaccgcgagcacaagcgcaccctgctgaccgacatcctggccggcaaggacgtggggcgcgccctggtcttcacccgcaccaagcacggcgccaaccgcgtcgtcgagctgctggagaaggccggcatcgatgccgacgccattcacggcaacaagtcccagggcgcccgccagaaggccctggccgatttccgcgacggccgcatcaaggcgctggtcgccaccgacatcgcggcgcgcggcatcgacgtggacggcatcacccatgtgatcaatttcgagctgcccaacgagccggaaagctatgtccaccgcatcggccgcacggcgcgcgccggtgcctcgggcatcgccctgtccctgtgcgacggcgatgaagtggcctatctccgcgacatcgagaagaccatccgccaggccattccggtggattacgagcagccctatcacgccgcccacatcgccacccgtggcttgcccggcggcccccgcgccaccaagccgccgcagccccatcgcggcggcggcaagggccaccctcagcagagccgcggcggcaatccccacggcgagcacggcgcccatccggccaagggccgcgacggcgccaagcacacccatgcgggcaagccggcctccggccgtcccgccgctgccggcaagccggcgggcaagccgggcggcgcccgtccccagggcggcttcaagggcatgcccggcggcagccgcagcgccgctcgggggtagccctctgacttctcttgtttagcctcatgcccggccttgtgccgggcatgtttgcttcagggggagcccagcaccatgcgggcgaggcgcggcgcgttgacgctgaccggcacttcccctccctcgatctccgccagggagaaccagccgaccgcctcggcatcgtcggcggcgaccggctcgcccaccgggtcgacgcagcgcaccacgttcaggacgtaatggtaacggattcggcccgcttcatcggggctgatgacctcgaacacgtccaccacgccccgggcccgggccgcaaggccggtctcctccgccagctcgcgcagggcggcggcggccagggtttcgcccacctcgaccaacccgccgggaaagccccatttgccgcgatcgggctccttgccccgtcggaccatcagcaggcggccgtcccgctcgaccagggccaggacgccgggcagggggtggttgggatactctctgggcatgggacctcgtcactgtctgcgccaaggacaatacggccggccggggggggatgtcacttctggacggcttgcctccggtcatcaggggttctactatgaacaccttgtaaatttatagtggtcaccaaggccgacggggttttcatggggttggccgtcttgcgggcaccggacgtgacagccggtacgataccgaaaccgcgcgagcgcatcgccgtgcggctggggctgatctttgccgcgctggccgccatcattgccgccattatggcccttgccgtctggagcttgtggcccgacgagggggaccgcagcctgggctggctgctggccggcctcgtgccgctgctggtgggcctgtcgttctgggccggcatggccatcggcgccggcgccgaccgccgcttggcctgcccgaccgcccggccatcggccgccggtgccgagcggtggagcgatcccctggggctggacgccgccctgaccgacctgacccaacggttcgagcatagcctgcacgaggtggagcagcggggccatgccctggtggccaacgccgagcgggtggcccagctgggtagtgccgagcgggacctgtccacaggcacgggggtctggtccgaggagtttcataccattctcggcctggtgccgggcgcctgcgttccggctcacgacgtcttcctggacgtggtccatcccggcgaccgcgccgaggtggccgagattctgcgggtcgttgcggccgagggcggccggcgcgaagccgacttccgcatcattcgtcccgatggcgaggtgcggatgctgcgcggctgcgccgaggtgagctgcgacgcggcggggcggccggttcgcatggattccaccatccaggacatcaccgagcgcaagcgtctggaaaacgaactggacggcttgatccgggaattgtggcgttccaacgaggagttggagcagttcgcctatgtggcgtcccacgatctgcgccagccgcttcgggtggtgggcagctacgtctcgctgctggaggaggaactgctcgacaccctggggggcgattccctggaatacatggggttcgtccgtgacggcgtgcggcgcatggaccgcctgatcaccgatctgctggcctattcccgggtggggagggtcatcggcgatgcgcccttcgccgcggccgaggccgtggagtcggccctgtccgaccttcagatcgagatcgaggattgcgacgccacgctcagcgtcgccgcggcgctgcccgttctttacggcgacaggggcgagatggagcgcctgttcgtcaatctcatcggcaatgccctgaaataccaccgtcccggtcagccgccccatgtgtcggtggagtgcgaggaccagggcggcgaatggctgttccgggtgcgcgacaacggcatcggcattccgcccgagcatgccgagcgggtgttcggcatcttccagcggctgcacgcccgcgatgaatacgagggaaccggtgtcggcctggccatctgcaagaagatcgtcgaccggcacggcggcgcgatccgggtcgagtcccagagcgggcctggaacggttctggccttcacctggcccaaaggcgcccaccagcctcagggcgatggctgagccttgcgccggggggggatttgatacaggctttatccctgggccaaatatgatcagggcggtggtgtggcttccaaggacattcacgacatcctgctggtggaggatgacctgggcgacgccgggctggtgcgcatcgcgctcaggcggtcgcgccatgtctgccgccttcatcacgtcaaggacggcggcgaagccatggacttcctgcgccggagcagcgcccatgcccaggcgccccgtcccgacctgattttgctcgatctcaacctgccgggccgcaacggccacgaaatcctggaagacatccgcgccgacgcggcactgagttccattcccgtggtgattctgtccacctcgggagcggaccgcgacatcaagaaagcctacgccctaggcgctagcagctacgtttccaagcccatggatgtggaggcctttaccgccgccatccattccatcgaggatttctggttcggcacggcgcaactgccgccatgaacgtccccccgatccgcgtcctgctgctggaagacgatcccgccgacgccaagctggtggggcagatgctgcgccgggtcaagaccacgcccttcgaggtcaccgtggtcgggcggctggcccaggcggtggagcgcctgtccgaaggcccccagagcttcgacgtggtgctggccgatctcggtgtgccggattcgtcgggcatcggcaccctgaatgccctgacccgggtcgccccccgcctgccggtggtggtgctgaccggcaatgacgacgacgccgtcgccctggaggccctgaagcggggcgcccaggattatctggtcaaggggctgggcgatgccttcatcctgtcgcgggtggtgcgctatgccatcgagcgcaagatgggcgaggaagtcctgcgcgaggcccgcgacagcgccgagcaggcggcgcgggccaagtcggtgttcttggccatgatgggccacgagatccgcacgccgctgaacggagtgctgggcatggcgcgcctgctgctggagaccgacctggacccgcgccagaagtcctttgccgagactctggtgtcgtcgggggaactgctgctggggctggtcaacgacatcctggatttctcgcgcctggatgccgagggcatgaccctggccgtcgagccattcgacgtgctcgatacggtggaggaggtgcgcctcgtccttgcgtcgcgggcggcggagaaggacctggcgctgtcgtgccgtttcggcgccggcgtgcgccgggtggtctcgggcgaccggctgcgtctgcggcaaattctattcaatctggtgggcaacgccatcaagttcaccgaccggggcggcgtggagatcggcgtcgagcccctagccgtcgaacaggggcagattttgcgcttctcggtcaaggactcgggaatcggtatcgcgccggagatcggggcgcagcttttcaccgaattctggcagggcgacagcggcgcggcgcgccgctttgatggggccggactggggctggccatctgcaagcgcctgaccgatctgatgggcggcgtcatcggttatgacagccttccggaccggggctccaccttccgagtcgacctgccgctgccgcccgccgaatcgcccctggccgaacagagcggcggaagcgaacgcccctgccgggtccttctcgtcgacgacaacgaggtcaaccgcgaggtggccgccggcttgctgcaacggcgcggccatcatgtggtgtgcgcctgcgatggccacgagggggtcgaggcggcggcccggggcggattcgatctggtgttgctggacatgcgcatgccgggcatggacggcatcgacacggcgcgggccatccgtgccctgccgggggaggcggccaaggtgccgctttacctgctgaccgccaatccggtgaaggaggacgaagcccgctggcgcgaggccggcatcctcggctgcctcgccaagccctttcgcttcgaccatatcggccacctgttgtccggttcggacgccgctccccgcgcatcggcccaggacacggacctggtggaggttgcgggtctgctgtcggacatgggggatctgggccgtgaccgcatggtcggattggtggaactgttccgcacctcgtcggcggccgacctggccgcgctggccgaccacgcccaagccggccggctggccgaggccggacagcttgcccaccgcatggccagcgccgcgtcgagcctgcacctttcccccctggccgccaaatgccgggcggtggaggatgcggcacgctcggaagacccggagaccatggcccgggccgaggaactggccgatctgtgggccaggtccctggcggcagtcgggcgggtcttcgacctctagtcaggtcattgacattaggccattagtatgtaatgattgcccgtgaaattgaggccgtgcctttgccggcccgccggtatcagaccttcgcgaagaaggcgtatcgcagactgtcgcggatgaagaaatcgcatccgcggcattcttttttgtccggccgcatgtcggcgatcgcgcaattccttcccgtccaataggtgcaatcccggcattcccgccgcatggacttctcgcccgacactcttgccctccatggtccgttggcggcgggaggatagcgtttgagtgcgacggttccatgacggctccatgaccgtttcgggtcgggatatcggttcggtctctgtccgcagtccagagaggggggcttgacgtattcggcccggaggcctcctaattcgggccatctcgagcccgcgaggcaaatgtgctgtcatctccggttaatgccgatctgtacaagaccctgctcgccaccatggccgagggggtcgtggtgcaggatttctgccgccggatcatttacgccaatgccgccgcctcccgcattctcggtcagagttcttccgacctgatcggcaagacctgcaacgtggaggattgggacgccacctatctggacggcactccgctgggcggcgatgatcatcccgccacggtggcgttgaaaacccgtcagcccgccgggcctctggtgatgggcatcagccgcggcggtgaacgggtctggctgcgcctgcaggcccagcccattgccatggaggccggtgaacccgatgctgcgcttgttacctttaccgagatatctgatctgatcgattccaaggtgcgtctgcgcgaggcgctgtctcggctggagctggcccatgcggccaagcaatccctgaacgagcggctggctgagtttctgggacgccaactggatgtgtcgctggagaccctggccgagagcgagcagcgttttcgtttggccatggaactgggaacctcggtggcgttcaccctggacctggacctgcggtacacctgggcccattcctgccaggtgggatttggcgatgccgatctgatcggcaagaccgaatacgacatcttcacccgcgagagcgccgacatgctgtgcgccatctatcgcggcgtgatcgagaccggggtctcggtgcggcgcgacgtgcaggtgcaaagcctggccttcagcaggccgcaatatttcgatctcatcgcgcgccggctttacgacgcgcggggcgagaccgtggggctgatctgcgccgctatcgacattactgaccgcaagcagacggaactggaattgcgtctggccaaggagatcgccgaaaaggcctccgcctccaagtcgcgctttctggcggccgccagtcatgatctcagccagcccatgcaggccttgcagatgtactgcgccatcctggcggagcggcagcccgagcccggcatcaaggccaagcaatgcgccaaccagctttcgcgccagctcaaggccctgctcagcatgtcgcgtctggacgccggcggcatgacggtgacgccgggaagcatcaatctgggggaactgctcgatctggtggcggccgccagccgccccacggcggacgccaagggcctccgcttgcgggtggtgaagacctcgctgagctgtgtcagcgacgccaccttgctcgaacgcctgctgggcaatctggtgaccaatgccgtgcgctacaccgagacgggcggcatcgtggtggggtgccgccgccgccagggtcgaatccgcatcgaggtttgggatagcggaatcggcattgccgaagagaatcttccgtttattttcgaggaactctaccagttgaacaatccgacccggcgtgccgatgagggattggggctgggcttggccatagtcgaacgaatcgccagaatcctggggatttccgttaccgtccgttccattttcgggcggggctctgtcttcgtggcggaattgccgatttcatatggcgtttgacctcgtcgtcgcagtggatattatgcgcgccgggagcggcctgatcacccggccggggttccacgggttggaggttttgcattatgaggcgtcgtctgctttccgtggcggcggccatggccgtttcgatggtttcggcctgcgccacgctgcccgaggatcccgaggaacgcgccgaggccgaggccgtcaacgatccgatggagcccaccaaccgcgccatctatgacgtcaatgctttcctcgacaccaatgtggccgagcccgtggccgagacctatcgcgacgtcatgcccgactggctgcgccaggccattcataatctcctggccaacatgcaggagccctatacggccggcaacgatctgctccagggcaatcccgccgccgccgccgatgcgctgggccgcttcttcatcaattccaccttcggtctgttgggcacccaggacgtggtcgcagagagcggcggggccaagcgccactccaccgacctgggcatcaccttcgccacctgggggatcgatgaaggtccctacgtcatgctgccgttcctggggccgtccaacctgcgcgacggcgcgggccgtgtcgccgattatttcgccgaccccatgggccgggtcttcgccgcccagggactgggtgtgatcaatgacgtcaatacgggcgtcgacattgtcgatacgcgcaccgagcacctggataccctgaaggaaatccggcgcacgtccattgacgagtacgccgccatccgcagtctctaccgccagttccgcgccgccgccgtcaaggcttcgctgaacggccagaaagatgcccgggcggcgctgccgagccagacgggagcaactccggtcggtgcttcggtcccggcgccctccagcgccgccccggccaaggccgccgagggcgagggcggcgcggcgcccaaggctgatacgcttaagcccagcgccgtggaattcgtcgaacagccgaaatagggcggcgttccgtcgtgcggcaggtcaagggggcgtccgcgagggccgccccctttcttcatgggagctcggtccgcatggcgtctcgctggtcctgccgccctgccgggaaaatgaagctcatgcggctggggggcttccagtgcccgggggcgctgtccttgtgtcccaggaatccgcgcgaccggcggcgcgccagatccatgaagtcgggacgcagccaggacgagatcactaccgtgtcgtcggccaacatggcgtcgagcgccgcggtgaaggccgccagatgggtcggctcgatccccgtgtcgtggatgatcaggctgccgtcgccgggcaggccgcgcaggatggcggcggcatcgccgcactggatgcggccccggcgggcgggataggcggtgtagaggaaggcgtcggcttccggcttgcggtcgatgcccagatactcgccgggagagccctcggcggcattgcgctccagagcccgcaggatcaggacggcaccgaagccccggtccactcccgcctcgatcacccgcttgggccggagggcgcgggtcagcaggtaataggccaggcggcgccccaggcgataatcggggtcatgggaccagcgctcgggcgaggactcgacggcgcggcgcacatgccgggcgaggtcgtcgtcggccaggatctcgtcgcgccagcccatgatccgttcgatcggaatccgggtcacggcggcgatggtccagcacaattcatcctggttcagccgcgtcgtatggtacgagcgcgacgcgatatcacgcgagcgaaaggtccagaccagcgccgcccacagggcgtgcagcccccgcgaccgccaagccgccatgcacagacgggggacgagcagcccaatccgtccggcccgggtcgacagcagaaaccgccgcaccgggggtggccaggaatcgtgaccagccatggggtcctgtcctttcttccgcgcgggcctttgaaggctggtccgcatcgactgcaacgggtcctaaaagtcatttgaaccccgttgggattgtgtttatcaatagccgccccgccggtcgaggacttcgcacaagacggtactggccgggcgcggcgctggaggttgggccatggtgcggcactatctggtcacgggaggctgcggcttcctgggttcccgtctggtgagcgccttgctggccgccggccacggagttaccgtgctcgacatcctcgcccgggaaaaggcgagcgccgttccagccgatgtccgcctgctggcgggtgatgtcgcccagcccgagattgtggcgcgggccatggacggggtcgacggctgttttcacctggctgccgtggcgtcggtggagcaatgcaatcggcgatgggctgaaacccatcggatcaatcagggtggttgcgtcaacgtcctggacgcggccaggctggccggcagagaacggccgattccggtggtcctggcctcgtcggccgcggtctatggggcaagtggcgccatccccctggatgaggcggcgccggcctggcccgtttctccctatggtgccgataagctgggcggcgaactgcacgcacgggtctcggccagcacctttggcggccgggtcacggcgttgcgtatcttcaatgcctttggcccgggacaagttcccgattcgccatatagcggcgtgatctcgattttcatcgaccgcgccatgaagggtgaggatctggtgattttcggcgacggggcacagattcgcgatttcgttttcgtggacgacgtggtacgcggcttccgccgggccatgggggtactggaatcctcgtcggagcccagggccgccatttacaatgtgtgcggcggaatgggcgtggagatcgggcatctggcccggaccgtcatcgacctttgccagtccccgtcgcgggtggtgcatgctcccgcgcggaccggcgatatccgcctctcggtgggaaatcccgccgccgcgcacgccgaattgggcttcgtgccgtcgtcccggctcgaagacgggctggccgccaccatcgcctgggccaagggcctggcggaggccggccggtgatcgtcggactggccggaccgtgcaatccccgggctctggcccatcacctccatcccgaagatgcggcgcggtcgtggccttgcggcaacggcctgccggtggaagggctggccgacgccctgatccgccacggacaccgggtggtgatctataccctggacgagcaatgccgcgagcccctgcgcctgtccggcccgtccctggccattcatatcggcccctaccggccacggcaccggatgcgggacggctttgccgccgagcgccgggcgctggtcgccatgatgcgggccgagccgcccgaaatcctcaatgcccattggagctatgagcatgccctggcggcgatggaggccgatgtggccccggtggtggtgaccattcacgactgggctcccgccgttctgcgctcgcagttcacgccctaccggatgggacggctggtcatgcatgccgtggccatggcgaaatgctcgcgtctggtggcggtatcgccctacgtggcggccaagaccaaggcctggttccgccggtcatgccaggtcatcgccaacggcatcgtgaccgaggccacggccccgcggccccggagttttcctccggggccgccggtcctggtcgccgccaatcaggggttcagccgcttcaagaacatctcccggctgctgcaggactttccgctggtgcgcgaggtcttccccgaggcccgcctcaggcttttgggctacggcttcgagcccggcggagcggcggagcaatgggccgccgcccgggagctgtgcgacggaatcgacttcgtcggccagatccccgcgccggaggtgctgaaggaattcgccgccgcccatatgatggttcatccctcgctggtcgaggcctgccccatggtcatgatcgaggccatgggccagggcacgccggtggtgggcgcggcggaggcttccgcatcggcctggatgctggggcagggcgccaacggcgtgctggcccaggcgcgccggccgggctccatagcccaggcctgcattgctctgctgtccgacccgaaaacctgggagcggacgggtcgggccgggtgggacgcggtccgcacccgcttcaccatggaccgggtggtcgaggagtatctggccctataccggtcggttctggcgtcttgaccacagctccctggcggcgagccacaggaagacgggaataacccgcccgtagcggctggtcaggcgtcgcggctcggacagccagcgaaaggcccattccaggccgcttcggcggacaaaggccggtgcctggggcttggtccccgacaggaaatcgaaggccgctcccacgccgaacagcaggatgccgggcaggcgggcggtgacgtccgccatccatttctcctggcggggcgcccccagtcctacccagaccacatccgccccggcgttgcgaatggcatggagatgggcctcggtctcctccggactggaagggccgaagggcggcgacaggcagcccgcgatggtggcccccggatagtccgccctgatgcgccgttccaggtcccgtagcacctgtggggtggagccgaacaggaagtggcggcaacgcccatcccctgtggccgccagcaggctccgcatgaagtccgggccatagactctctcggatttcaggcccaaccatcgccccagccagaccaggggcatgccgtcgggcagggccagggcggcgccggccagagcccgggccaggacggcgtcttgctgggcgtcgaccacgccatgggcacccaggtggcagatatagccgccgcttctctccgtgatccggttcagggtccagtccagggtcccggcgaagctgggcgaatcgacgcggactcccgcgatcaggatgctggggatgtgggtcatggcggcgaggcccgcaggcgggcgtaatggccgagcagaaggtcggtgaccacctgggggctgtaacggcaggcatagacctggcgggcgttttggcccatggcggccagaagcgcggggctgtcgagaagggtgcgtgccgcatcgcgccaggcgtcgacatctccgggcgtgacgcgctttccggtgacgtcctcttcgaccagggattcgagcgccccaagatccgaggccaggatcgggaggccatgggctgccgcctcggccaccaccagcggccattgctcgtagcaacgtgacgggaggcacagcaaggcggcctcggacaggatggaggaaacccgggccgggtcctgccagccggcgaaatccacctcggaggaggcctcggcccgcaacgcggctgccagaggaccatcacccacgatggtcagccggtgccccatgtcccgccaggcccggatcaggtcggcgatacctttctccgggctgaggcggccgaggaagacggctccgcggcgggggcgccgccaggacgcggcttccgcgccgggatcgcaaacggtattgggcttgagcgcgatacgttcggccggaagaccggcggcgacgaagcgccggcgcgcgaagtccgacccgaccagaaacaggtccacgttccggcgccaggtgcccgccaaatggtgccagcaattcatcgccgccaccgcggcgctggccttggtgtcgtcgcggtaacagcgccgcagcacgccacgccacgctaggggactgcccaggcaatcctcgcaaggctggccatcgcgcaggaacaggccgttcaggcacatgagccggaaattgtgcagggtctggaccaccggcaccccctcggcccggatggcgccgtgaatggcgggggaaaacagggggaaccagttgtggatatggacgatgtcggggcggaactcctggaccttccgccggacccggccgcgtccgtccgtggaccagacggcattggcggccagggccagtcctccccgtgtctcatcgatgtggtcattatcggccaccagccgttccaccacgcagccacgttcttccagcagggcggattccgtgtcgaacaccgcgtcctcgccgccgcgttggcgatagcgttcgtggattatcaggatgcgcacgggccacccttcgcgaaagcggtggcgttgtccacccggcgggtggcgggaatggccctggcggcacgggcgagaaagcggtccagcaccggccacagcccgccttgctccatttcccaggaatgtccccagaggtgcaacgtgccaccggtgcgcaaggcctcgtccagcagccagtccagccgcgcctccaggccggggcgggccagacagcccagacacagtcctagccgctggccccccagcccccggcgaccccagttgctcatcaaggcggcggcgccgtgggggtagacctgcagggtggtggggcgggcgaaggagtcgtgaccctcgtcgaggcggaacatttccaccgtgcgcgcgtgggtcaggcccagtcgggccgcgtggggccgcaggcgggccattccccgtccgccgggggggcagaacccgctcaccggctggcccaggcgctgctccagctcctccttgccccgcgtcacctgatccagcatctccgccagatccaggcggtcgagccgcagatggtcgtgggtgtggctgccgatctcgaaccccgccgccgccaattgtcgcacttgggcggcgtcgagggtcgggcgtccctcgctgttggcgatgggcacgtagaaggtgccggcgatgccgtggcggatcagcatctccgccaggatcaggtccagggggtggccgtcgtcccatgaggtggtgagtgaggcctcagtcacgggccgcccttgccaccagcgcttccaggcgctgggcgtaaaggtccatgctcaggccgtcggcggttctttcggcgccggcgcgcagggcgtcggccagaccgggctcggtcagcagccggcgcatctgttcagccagggagcgggcggtcagcgcctcggcccgcaagccattctcgccgtggcggaggtactcgacctcgaccctgtggcggctgccggggccgatgacgaccgggattccatgggcaaaggcatgcaccaccgcgaggcccgccgcatcgggcatgatggcggcctgggcctgggcgaacaggcgggcgagatccgccgggtccctgcactcgcccaggacccgcaccgggctaccttcgcgggcaaggcgttccagttccgcccgatcgctcccctctcccaccaccagcagcaaggccggatggcccatgccattgagggtcgccaccgcttcggcggccaggggcgccatcttgtcgcgataaaggcgtccgatgaacagaaagacggccggtcctccctcggccggcgcgggccgtgtcccttggacggaagcggcctgggtgcggatggcttccacgtcgagggtattgcccagcacctcgatacggtggagcggaatgccgatggcccggcattgccgctcgcccgatgaggtgtaggcggccaggtaatcggcccccctgatccaggcgcggcgcaggcgggcgatcaggttttccggcttggcgtccaggttgaaatggccggtcaggatgatcctggggcggccgagcagcctggacgccagccagatcagccagttggacgcggtgtagacgtgttcggccatcaagacgacgtcgtagccaccgaacaggactttccagacaccgttacaccagaggatgcggtcccccccccggggccaatagaaattccgggaccggtggtggcggatggcgggtggcgggtcgcaatcgggctctccctcggggtgggacgtgccgtgaaagacctcgacgtcgatctgcccgctatccctcagccgggtcagcaggggcaggcggtaccagggcaggaccggctcgatcatggccagccgcggccgttcccgtcgccttgcccgggggcggaagcccgcccataggcagcggccgacatgggtcgcccaccagaacggccaggcccagccgccatggcggcggtagaaggtcgcggtctggcgtctggccggacccaagggaccggacagggacgcaaggcgctcgccaaggggccgccctggggtttcccagggagagccgccatggttggccttgcagcggcccgccggccggggggcgaccagcatgggaatgccggcccgtccggcccgcagcccgtaatcgatgtcgcccaggggctgtccgccggcgaaagcgtcatcgatggggcccagaacgccgaaggccgagcgcggaaccagcaggcaattgccgttgaagctgtcgcagggtgtggcggcctgacccgaggcgaagacccgggcgaagcgaaaggggtggagacccgggcgccggacatgcccgccataggtgggacaaccggattccggatcgaccatggcgccgaccacgatgggggggcggcgtccggccgctatctcgccgtcgtggaccgccagcaggtccgcgatggcgttctcggccaggaccacatcgtcgttcagccagaggtgggcgtcggcggcgtctgccatggccgccttctgcgccagggccatggcgccgttccagtaaaggctgccgtcgccgcggagcaggcggacggaagggaaccgctcggcgacagtctcgaaggtgccgtcggaactgccgtcatcgaccaggatcacgtcgagggacagatccggcggcagggcctggcggaacagggtctccagggcggcccgggtgacggtccgccggttatggcaggcaaggagggcgacaaggcaccgaccgatcatggcggcgccggttgggaaacgccttccggaatcgggcggcggcggggtatggcgggaagagccagaatcagcccaagaatcagcgccgtgtcgtattggggcgaataactggcgctgtacaccaccacgccgatcaccatccccggcagcgccagcatttcattggcccccccgtggagcgcctgggacagcgcccgtctgaatacggacaggatggatagaacgaacaggccgcatcccaacagccctgaggtcaggaacaactcgacatagtaattgtggggcgaggccgtcacatataactgagcgatgtttcgctcgtatccgatgccgaacccggctccgaacaagatggacagcgggccgtcggaaatggcccgctccaccaggatacgccagccctggatgcgccagtccagcgtgttgttgtccaggtcgacggcttcattgactgccgtgcgcagggacgccgagaggatatccatatccaggccgaccagcagcagccataccagggccagggcgaccagcaggaactggacgacgacgaacgccctcacggcgccacgtcccgaggccgccagcgtgaccagcacgctgaccgccagcatgacccagaccgagcggtggaacaagaagatggagaccgccagcaagggaagagtagccaggcgcaaccacaggcttgaacccacctgaagccaggatggcaggctgagcaaggcggcgagggcgataaattgggcggcctgggcgggcagcacgcggctgcgctcgtaggcctggctggacaaggccatatggccggggtcctgcggtcgccattcgggcaccagccaggccgcaatggcgaaaagcaccactgccagtccggccaggataaccagattcagggtccagatcgtatcgttcctgtcgtgctggaacagcgcgaagtagctgaccccgacggtcagatacagggaagcccggtacgaggccaccgccgtctgcagcccgtaggacagggctccgtggagaaaggccagtcccagatatgtggttagcagcacccacagcaacgtcaagccatctattcgacgcagggaaattagacggatgagcgtggcgattgtcagtgaaataaagaaaatatctgtgccatggattgtagttccaggctcgattggaatgtgaatgggtgagacgaggtgaagatctgtgatcgatatcgccaggatgaatacagccgtcaaccgccgtgagaacagcgatgtggcgaagaataaagccgccgccagtataatggctatggcaacaacctcgtccattcaaaaccttttccatctgcgcccaatggtatataacggcaccgccgctgcggtctagagctttcgcaccgggctgggcggggcagagccgaaagaatcgatccgtgacacgtagcgtcgtcattattctggccaggctgacacattccggcatcgagaccatgatgcgcgccattggtccggaatgggccggacgcggctggtccgcccacatcctggcgacgggcgaagaggacgaggggcctttcgccgacgagatgcgggccgctggctatgtggtgcaccatgtgcccttccggcgccatccgggattctttctcgatgtctggcggttctttcgcacacaacgcttcgacgtgatccacatccattgcgagcgggccaatttctggtttggattgctggccaccctggccggggccaaggtgttccggacggtcaacaatatcttccgcttcgagggtgggctacggctgcgccggcgggtgcagcgctggctgtcctggcgcctgggcgtggtctgtaccgcgcctgggcccgatgtcatcgcccatgagatgtggcggttcggcaatccctgtcgccagaccccctattggatcgacgaacgtcgctttccgttggtggacgaggctgggcgcgccgcggcgcgggcggcgctgggctgtgccgccggccagttcgtgctggtgtcggcggggcggtgccacgacatcaagaaccatgcggcgatcatccgggctttgcccctgttgccggacaatgtgatctaccttcacgccgggggcggaccgctggaggcggaggaatgggccctcgcccagcggctggggctggacgcaagggtccggatgctgggcgtggtggacgggattcacacggttctggcagccgccgatgcctttgtgatgccttccatcaccgagggtctcggccttgcggcagtggaagcccaggtcatggggattccctgcgttctcagccgggtcgaagggctgtcggaactggccccccacagccgcgccggcgaatggtgcggcctggacgccgaatccatcgccgccgcggtgatccggcttcgccagaaggatttgggggaggtgcgccggctggccctgctcgatgcggaggacgctcgccgcatctatggccgcatgaacgggttcgagggcttgctgaccctttacgggagcgccgggtgagtctggacattgcccggtcgctgcggtggtcctatggcgggatggccgccaatctggtcctgcaggtcgccttcgcggccctggccgcccgcctggtctccgccgagtcctatggcatggcggcggtggccaccggcctggtgtcctatctgtcctatctgtccgatctgggggtcggccttctggcggtacgcaaccgagacctggatgccgccgatctgtggggggtggccctggtcggtctggccggcaatctggtcatcgtggccgcggtctggctggctgcgccctcggtggcggcctttgtcggattttccggggagggggtctgggtgttgcgcgccctgtcgcttctggccccgctgggaggccttaacaccgccgccctggcctggctcaaccgtgaaatggatttccgcgccctggccatcatgtccctggtcggcaagctggtcgggcaaggtgccgtcaccctgccgctggcctgggcggggtggggggtgtgggccctggtggcgggggcgttggggcaggtggccgccggtctggccatcgccctttggcggcagccgcctcgcctgcctcgccggtcccgctggcccgccatcggtgcggcgctgcgggtgggggtcaatttctccctcatcaggcttctggactcgacccaggcccagatgattcccctgtccgccgcgaccctgatgggggctggggcggcggggctgttcgatcggggcgccctgctgaccctggtggctctggagctgatcacggccggtgccgggcgggtgctgttgccggtctatggccgcatgggcgaggaggagcggggccgcattccccaggccttcctgtccgcctgccgaagagtgctgtgcctggtgctccccctggccgccggcgtggcggcagcggccgagcccctggtcctgaccgtgttcggcggcggctggtccgccctggtggagcccttgaggctgctggcggtactggccggtctgcgatcggtcgccatgttggccggagggttggtggaggcccaggggggcttgtaccacaacatgatgcaacgcatctgtgtccttgtcctgttgctgagttggatctgcgtcgtccggcccacggaactgggatggctgctggccggagccgttctggccgagggggcgagcgccctggcgttgctggccctggcgtcccgggccgccggcctggcgttcgcggcggtgctggtgccgccgcttctggcgctgagcgtggcgctgccggtgggcggcgtcatggccctggcggccggtgcggatggctcgccgggctatcgcctggtcctgaccatgctgtgtggcggcatttgcctgggcggcgttcttctgctgcacccccattccggcttgaggggcgaggtgcggaggatggttcggcacgctttcgctgggaatgtgtcattatgacgtctattgttgcttgcaatgttgcgaacagggatggctaactggctcaatgagattggttatgcgggagagtgagttgcgggcgagcggcgccgaccgggttggcatggccgggcgggcggtggtgcctttgctgatcgcggccgatgtgctgacactggagcttttcgtgctgctcggaatgtggctgcgcgaggcggtatccgtctggttccccatctccctggcgccggtgacgtttcatggcattcatctggcagttctggtcattccgctgggctgtctggtctgggggctctatcctggctatggtctgtcgccggtggatcgcctgcgccggcggactctggtcgtgctggtcgggttcggcctgatggacgtctacgaccacctggggcagaacgggcaatggtcgcggggcgtgttggtcgtcgccatggctctggccgtggtggggctgcccataacccatgcctgggctcgccggaccttgctgcggctcgggctgtggggcgagaaggtggtgttgctgggcgatcccgaacggtgtcggatgacggcggccgcgctgtcggcgcgaccggatctggggtggattcccgccgggattggcaattggccgctggacggcgaggggcattggaacgacgcggagatggcgattctgttgcctctccggggggagctaagtctggccgaggcggcggattcattgccgttccggcgcatggtggtcattcccgacctgggcgggcgcagtctgggcgtatcctccctggaaacgggcctgggcctggggctgggaatgcgcaacaacctgctgtatccggtgaaccggatgctcaagcgcagcctggatctggttgcggttctcctggcgttgcccctggcgttgccggtgatcgccgcctttgccctggcggtcaaggtgatctcgcccggaccggcgttctacgggcagcagcgcgaggggttgggcgggcggccgttccggctgtggaagatccgctccatgacccccgatgccgagacgcggctggacgaggtgctgggccaggatgcgcgaacccagggtgaatggaagtcccggatgaagctggaggacgacccgaggatcattccgggaatcggccgcttcatgcgccgcttctccatcgacgaactgccgcaactgctcaatgtgctgctgggtcatatgagcctggtggggccgcgtcccctgccggcctatcatctggctgaaatttccccggccctggtggcgctgcgtcagcaggtgcggccgggcatcaccggctgggcccagatttccgggcgcagccacagcacggtgctgcaacaggtggaatatgacgcttattacattcgtaactggtcattctggatagattcatacgttctggcgcgtacggtggaagtggtgctgtcggcgcggggggcgttttgatgtctggccttttcggccgacacaaaatgttacttctctcccggggggatttttcgttgtgcgattgacggggtgtgcatctttttattaatttgctctttagaacttgatgacattctcatccgaaacgggaagaacggctcgtttcttggcacaaggagttggcctcatgcgattcgcatcccggattctgccgagtgtagcggccggcaccctcgtcgcggtcctgtccacgacgggtctcgcccagactccgccatcgtcccaggggggcgcgggaacccaggcccaacaggcggtggccttgccccctgcgctgcaggcggccattcagtcgggcaatgccgaccggatcatcgccgggctgacggcggcccagatcggcaatcccgccttcatgcgccagttcgccgaggccctgggccggagtgcgtcgacccgtggggcggcggccctgaatctgctggtggaaagggtcgcgtcctccctgagcgcccgggtcagcgcggggcaaagcatcgcggtgctgcaaagtttcggtgccggtcttacccagggcattgcccaggggaacccggcgcaggcgggacaactgatccagtcgagcacggcggccatggtgtccggcgccggcaagaacgaggcccgggtgggcgaggtggctcgcgccatcgcctccggcgtggtcgagtcgctggtcctcaacaacatcgtgccggtggccaacatcgccaccatggtgcagaacgctgtgtcccagggtgcgtccaaggtggtgggcgcgcaggtcaccgtccaggtggaaagctccgataccaagccggtcgctgacgtggtgctgatccgtcagaacggccagaagctggataagggacaggatgtcacctttgtggacctgggcgacaagaacaagccggtgatcgagaagccggtcgtcaatacgtcgcctagctgatccttatcctccagtctccgatttccaccctcatgtcgagagtgttcgcttcatgtcctttctgcttcgtacctcgctggcggctttggtggccgtgggtgtcgcatccccggttctggctcagcccactccgaaagcggaagatctgaccccgtcggagaagaacaatcttctgcgcgaccaggaggtgaccaagcgcgatcagccagattacgccgccaagggggtggatctgggcggcttcaagtttcttccgaccctggaggccaccgagcggttcaccagcaacctgtattacgagcagaacaatcaccgcaaggaactggtcaccacggtgacgcccgggctccggctgaaatcggactggaatgtccacgagctggaattctacgccaacagcgagatcaagcgtcaccgccgcttctggggcgaggatgtggagaactacaccgccggtgccaacggcaagctggatgtgaccagcgagttgctcctgcgcggcagggtcaactggaacgccgggcacgaggcccgttcctcacccgacgacgtcggcggcatcacgccgaccaagacccagacccagggcgccatgctgggggccgaatatcacggcccgcgcatccgactgcgcacagaggccgaggtcaccgaataccagttctgggacgtgcgcaaggccgacggcaccatggccaacaatacgggccgcaaccgccgggtgggcgaattgcgccagcgcgtgggctacgagattattcctgaatacaccgcctttgccgaggttatctataacgaccggcgctacgacaccgccgatgccaatggcacgcaccgcgattcccatggctgggaaaaccgcgtgggcaccgagatcgagatctccggggcgctgcgcggcgaggtgttcgcctcgtacctgatgcagtactacaacgatcccatctatcgcgacgtggaaggtccgggcgccggggcgtccttgacctggactcccaccggcctgaccaccgtcaagggagggatcaagcggaccatcaacgaaaccacctcgcgttactcggccggcaatctcgccacccgctatgacgtttccgtcgcccacgaattgcagcgcaatatcatcctggaggcggacggcgccctgacccagaccgcctatatgcggttgggtcgccacgataagctgtggagcggcggcatgacgggcacttacaagatcaaccgctatctctataccgccctcgattatcacgccgcccggcaggataataatctgtccaccggccagtatctcgagcactccaccttcctgaagctgggcgtgcagtattgattgctcacgaggcggcggcgtcctaccctgtagcctcctcgcggactcaaggaatgatgcggatgcggtggttgcgtatcgtggccgtcctgctggtggcgggatgctcttcggtcggttgggccgccgacttggcctatgttctgggccccaacgacaaggtcaagatcaccgttttcggtgagccggatctgtcgggggagttcgagatcgggggctcgggcaccctggccatgccgctggtcggagaaatccccctgggcggcaagaatctcagtcaggcttcgggcctgctggccgagcgcctgcgccagggtatcctgcgtgatcccaaggtctcggtcgaggttttgaattaccggccgttcttcattctgggcgaggtcaaccagccggggtcctatccctatgtcaacggcatgaccgtggtcaacgcggcggccatcggcggcggctttacctaccgcgccgacaagaaagacatcaagatcacccgcgagggcgcccagggcaagaccgagatcaagggccagatggaaagcaccgtcatgcccggcgacgtcatctgggtgggagagcgcttcttctgatcccggccggcgtagcctggatcagcccggccgtgtccccctccagaaccagacaggacagcacattggtgcaataggcgccggtgtcgatgcccatgcggttgtccaggatctccggctggggaacgatgtggtggccgtggacgatcatggcgccgtggaatcggcggctggccaggaattcgtggcggatccacagcagatcctcgggggcctgctgctccagggggcgccccggccgcacgccggcatggacgaagagataatctcccagccgcaacgatgtcggcatcgccgccagaaaggccttgtgggcggggggcagcgcggcggccagttcggcctgcatgcgttccgagcgctcgcggctgggggcgccggcgatggggacgacgccatagctgaccagggtggcagctccgccgtattccagccagtcgggaatggccatggggtcggccagggcgtgcaggaaggcgtcctcgtggttgccccgaagggcggtcaggcggcaacccgctggaagggcggcaccgatcaacagatccaggacccggcgcgactgggggccacgatccagatagtcgccaagtcccaccacctcgcagcgatcccaggaccgttcggctcgggccagatcgccgacgacggaatccatcagtgattgcagcagatcggcgcggccatggacatcgccgaaggcataaatcctcgtcccgtcgggggggcggaacggccgggcgatcccgcggtttcgccggaacggccggatcagggtttccaggatggacatacggggattgaggactttccaaagcgattagagttagaaacggtcggggctttcccttaatatcgccccaggttcgtagcgtgcaccagaaagaacgtcagcatgaacgaaatttatcccgttcgcccgatctccaatgcgtctgcgacgcggacggacggtttcaatattgatctcaggcaacaaatacgtgtgctgtggcgccgccgctttctggtgttcgccgtggcgggcggcgtgttcatcgccacctggctgttcctgatgctgctgacgccgatctatgccggcatggccagcgtgatgatcgacacccgcaagacccgggtgctggacctcaaggaggtcatcaccacatcgcagccgcaactgaccaccgtcctgtccgaggtcgaggtgatccgctcgcggaatgtggccgaacgggtggccgcctccctggatctgtacaaggacccggagttcaacccgtcgcttcgccccgccaaaagcggtgtggccgccgcgctgaacagcctgatgtcctggctgagcgcgcccaagcagcaggacctcggtcccgaggaggccgaacgcgccatgcgggccggcgtggtcaccacgctggtgggccgggttaccgcagtgccggtgccgcaatccatggtgatcaacgtctcggtgcggtccgaggacgcggccaaggcggctcagttgaccaacgccctggccgagcaatatgtcctcgatcagctgaactccaagttcgaggccacccggagcgcctccgtctggctgaaccagcgcctggaggacctgcgcaacgcggtggcccagtccgagcgcgcggtggcccaataccggggaagctccgggctcatcgacagcaagggcgtgctgcccacccaccagcaactggccgagttgaacacccaactgatccagactcagggccggcgttccgaactgcaggccaaggtcgcccggctcgagactctgatccggtccaaccggggcgccgaggcggccgacgaaatgatcgagtcgcctctgatccagcggctgcgggagcaggaaaccaccctgatgcgggaaatctcggatatgtcgacccgctatggcgacatgcatccgaagatgatcaagggcgttgccgagctgaacgagctgcgggccaagatcaacgtggagatttccaagctcagtcagggtattcataatgaatacaatgtggtcagggctcgtgaatcggcacttctcgatcgcatccgccagttggagggaaccgtcaaggagcagaaccggtcggaggtccacctgcgcgagttggaacgcgaggcccaggccaaccggattctctacgagaacttcctcagccgctttaaggaaacctccgagcaggaacaggttcagcagcccgacgcccgcatcatctcgcgcgccgtgcggccctattcgccggcctttccccgcaaaggcctaatccagttggccatgaccgtcgtcggtctgttgctgggaacgattctggcgctggtgcttgaacggctggacaataccttccgtacgcgggaggagctggaggacgtcaccggactgccggccatcggcatgattcccttcgtcgacaagaagccggtggcaaaatacctcatcgaccgtccgacttcggcgtttgccgaagcgttgcgcgggctatggatcagtctttgccacagcgatcccaacagttcgccccgggttgtggccatcacgtcgtcctttcccggcgagggcaagagcatgaccgccctgtccctggcgcggacggtggcgctgctgggcagccgggtggtgctggtcgattgcgacctgcgccgctcgtcggtggccaagctgctggagatccagccggagcactgcctggacgatgtgctggggggcaaggtcgagttgcgcgccgccgtcttgcgggaccagtcctcggacctggatatcctgccggcccgcaacatggaccgggcaccgctcgatatgctgaactccgcggtcatggagaatctgctccacaccctgcgggggatctacgatctggtgatcctggactgtcccccggtcattccggtggccgaggcccaggttctaggacggctggccgacaagacggtgttctgcgtcctgtgggaccagaccccgcgcgaagcggtggtcaacgccctgcgtcagttgcgcgatgtccaggtcagtctggccggcgccatgctgaccaaggttcacctcaagaagcatgcccgctacgggtatggcgacatcggctattattatggccgctacaagggctattacgccgattgagatgaatgcccttcgccgtcgaccagatgcagttctcgttggcttcctggggctgatcctgatgggtctggtcgggccggcggccctgcgcgagctggcactgctgccccaccacgccaccatgcaagccctcgccgaggggggcgccatgcccgtcgaccgggtggcggagctgggggcggccgtcgcctgggccgagaccttttccacgtcggaccgcctggagcgcctgtcggcccgcatcaataagcggcgcttcgatcgccctgccgaggtggaggccctgcgccgggctgcccggctggccccgggcgattcagtaaattggatgcgtctggccctggacttgccgccggggccggacgcggcaagggccctgcggctgtcggccctgaccaacgccctggaatacgatgccacgccccgccgggtcgacctggggctacggttgtggccttacatggacgatggcgataagcaggctttcgggcgtctggttctggcgttgtggcgctggcaaaccgggcggctggccatggtggcggcgcggcgcggcgggtacgatcaaatcgcgccctacctcaaggcggtgtcccaggaagattgggagcacttcacccgcagctatgccatccaccgtctcaatcccgaggaaccttacctccacggcccgccctgaccggttcgggctggcggcgtgcccgatagcggcggatcagccagcccaggggccgcagcaggggatagagccagcgcaggaccggcggcaggttgaagaggtgccagtccaccggctcggacaggtcggccagcaggcatgacgccgcccccttccaggtccggcggagcgtgtagcgcccccatcgcagccgaagctcgcgcatctggtaccaattcacttggtcgggcgccgggggacggacccaggccgtttctgcgacgaaccagcgatgatggcgcttgatcaccgcacgggacttctccgcctccccagcgggagagggagcttccagcagatggcggcaaagaatccgtgcgtcggtaatgcccgggccaaggtccaaggcggcggcttgggcctgtgcagcccggtacaggggctcgtcctggaacaggggagccagatcggcgatccagcgcaggcgggtccagccgtgttcggccccatggaccaggaggtaaagcccctcgtgctcggcggaaagagtgaagaccggccatgtccacccggggaccgtacgccgcccctgccacaaggtttcgaacgaaaagggcagcaggctttcgtcctgggtcagacgctgatgcagttccagcagatgcccgtgggcatgacggaaggcgagatcccggacggcggtggcggatcgctcgatgccgctggccgccaccctggggtcgtctagagcgtatccgagcccggccagcagcgtgcgcgccgcgtcgaaccgcaggggatccaccaataggtcgatatcgcccagaccgcgccgcgacggatcgccgtggatccgctgggacagggcgacgcccttgagggccaggcagcggatgccgctggcttccatggcctgggtcaggcggatcaactccgccgtttgccgcaggcagcgccggacctgccggtcccgacggccgatcagatcgtttctgaccgcggccggcatggccgctgcccccggtcgcagggccagatcggccaccagcggcaccacgtgatggcttgttgccccagccaccacctgggaccaatcgccaatggcggcggcgcacgcggcgatggcctcgtcggggacggcgcggcgggggcgtgccgccaggcacaacaggcggaagcccggaggcaggcggtcgaattcggtcatctcattcaaccaccgagcccatccggctggaccaggactgggcgactcccactcccatcatggcggccaggacataggcaacggcgggaatctgagggctgaaatccaccagggcgtgggcgcctaccagcaatccggccgccgccccaagggcgggcaggtcccggttccggtggcgccgcaccgccgcgacgaggcagcggcgccaagcccatccggcggccagaaacaggctgcaggccgccggtgcgcccagctccaccatgagttccagccaggaattatgggcctgtgtccagatctgggtgatcgagcccggccggatggcctgaaaagcatcgggaaaggcgcccaggccctggcccagccaggggcgctcggccagcaattcccacgagagttgccaaacccgcatgcgctggggcacgtcggcacccaattccgtcagccgctcgtccatttcgaggaccgcgatcagggccgcaccacaggtcagtcccagcagaatggccagacgtttccagttgcgttgctggctcagcaccagcagcagacacaggcccaacaccgccacggccatgcccgcccgggaatgggtgaagggcagggccagcgcggtgagcccgccgctggccagtaagccggccgtcaggcggtccttgccgcccaaaaggccgcgcaggcattcacggccaccgcgctgctcccagcgggcgagagacgcggacaccgagcacagcaggccgagcccggccagggtggcatagtgattgcgattgaccaggaccgcggtaaggtcgccgcggtaggcccatttctccagccagaagatggtttcgctgccgctaaaataaaccaccagcccgtaaagggcgatggcacccgaggccaaagccagcgcttcgaccagacgggcggcccggcgtggcgagcgccccatctgaaccgccaggaggaatgccagcccatcggccagcaattgcgccagggcgtcgcgcccggccgccggggccatggaaattctgcggggcaaaggccccagtgctgcctcggcctgcgcccagatggggtggtcccatccctcgggcgccagaggcagaatctggaccagaccccagatcagcgcggcgccgtaaagggccaggggcagtgccaggacccgggcggaaacaccgggtgtctcgggagcgcgaagcgtgaccagagcccaggccgtggcgatcaggcccagcagcgtcgccgccagcgcgccgctccagggtcggaacgagcccagaggcagcggagccagcaccagcaccgcgacaaacaccgtaaacgtcatgtcttgtgagctgaatccggctttcatcgcttcccaggggctggtaccgctatagcattcgtccggactggcgtccaccaccactccggtagtgctccggtcccgccgattttgcttcccggggttgagtttcccggctggcggtttatgttgaaatacgccagtgccccgctcccgcttgccgaagagattcatgcgcctcccctacgcctatcgattgtgcacatggcgagttgacagcgacctgttgctcccggaactgatcacctggggcggcggcggcgatggttcggcggcggatctggtcatcgtccaaggatcggttcccgaccatctggatgatgcggtgacgccgggcaagttcatcgtggtgggtgccgatggttcggtgctgcttcacattcgcaatctggtccgcatcctggtccaggacggccggcggattacggttgagattctgcgccgcgatcccgaggaaagctggcggctgttcctgctgggctcgaccctggccatcttgtgtcatcagaggggggcttatccccttcatgccgcctcgctgcggatcggcggccggactctggccctggccgggcataccggggcagggaagtcgaccctggcccttgggctggtcaatcgggggcatcagttgctgtccgacgacctttcggtgctgcgcgccggctcggatggggtggacttgttgccggcctatccccgcctgaaactgtggcggaagtcgcttgaggcactgggggttggcgtggaggggttgccacgggtgcgcggatctctcgaaaagtacggcctgtccccgtccgggccgttcgatccccagccgagccggctggacggcatcgtcgttctgaaggacggccccctggtgcggatcgagcgcatgcgggcggtggcggcggtgcccgatcttcgctcccatgtgcagcggccggggatcggccagcacctgcgcggcgcggcggcgctgctggccgaggccgggcgcatcgccgaggctgttcccgtctaccggctggagcggccaaagacctttgacgatgtgggggccatggtggaactgatcgaggctttgccgggacgatgagcgaaagcggcatcacctgggtcgcctcctatcccaagtccggcaatacctggatccgctgcctgattgccagcctgcaggctggaggcgcagcgcctaggatggcgtctcttgggcggttctgtcccaacggcgcggccaggaactggctggaagagattcttgatatcccgacagaggacatggtgccgccggaactggccgtgttccgtgccgatgtctaccgccatctggcccaaagcgggggtgagacgcgcttcgtcaaggttcacgatgcctatgatcctaggctgttcccgccggaggcgacggcaaggacggtctatgccgttcgcgatccgcgcgacgtggcgccgtcttgggccctgcatatgaatgtgccgctggatggcgccctggaccgcatggaaaagccggacttcactctggcgcgcgtgaatgaccggtacaattcccaggctgagcagtgcctgacggactggtccgggcacgtggcatcctggctggatcgggcggccgcccaagggccattgctgctgattcgctacgaggatctgctggccgatcccatcacctgggtcgggcggctggcggagttccttggaattgccgttggggacggcctgatcgcgcggactgtttccgcctgccgcttcgaggcgctgagggccgccgaggaaaacgaaggcttcagcgagaggccgccggtcctggagcgctttttccgccaggggcgggcgggagcctggaacgaggtcttgaccccccggcaggcggcccgcatcgttgccgcccacggggcgatgatgcggcgcctcggctatgtgtcgggtgaatagcccacggtcggcggatggagcggcttgccgccggtgaagtccagataggagtcgtccttgatccagtaggcgaacttgatccaatggaccatggccgtcatccgccgcagccggtaatcggcgggggcggggatggtgggctggaagcgtgcccgaagaccggcttccagttccgccatgccctcgggaaaggtccagcggtcggacggcccgcacgccgcctcgtaattggagcagccgcgcttgatgatcatcgggacgtcggggccgagatggggctgggcgtcgatggcggcgcgcagggcaggataatcggcacgggcggcatttaggccgtcataatagaagaacccggcgtagaaatcgcgcgaatgcgggttgtagaagtcgacgccacatttgcaggggccggtcagggattcgagaagactgcgcagcgccaccagggcacgtaaatccggaggaacgatcttgatcttatagcactcgccacagccccgcggcacggtggttcccgcataggcatggcggaagaggaaggcgttatattcctgacagcgcagatcgggagccgagcggaccagcagataccattcgcttcgcgacggcggcttggcaaaatccagggcgccggagggcaacacccgaagctttacggcctcgattgcatgggccagattctcgtccgcggttcgtcccgcgaagcgcaagggaggggcgccgccgctcatcgcattctccgttctgcggcgcgatgatagcgcgtttcaggcggtttccaaactgtcccccgcttgccgccagtccatgcgccatgataggccggtatcgccggtgatgcgaaatcccagacgctgatagaggcgttgagcgggattggtcttttccacatgtagggacacgccgtgcccgagtggagccagaaccgactgaagctccgagatcagggtgccgccaatgccttgcccccgatattgaggggcaaggctgatgtcgaggatgcgcacgtcccccctgtcatccgcggccaggtagaaccggccgacccagccgtcggggccgcccaccacccagaaggcggtcgtgggatactggcccagatactggcggcgctgcatgtcgaactgctggtggacgaagcgttccttctgctcgtcgctgaacggtaggaaagccagttcggtctggcgcagggcggcgaaaagcccgcgcagaaacggcaggtgctctgccgcttccgctacaagtctgtatcccttggcagccagtgcctgtggacaatggaagccgggaacgggcatgggcttaaggccgctccggccagtcgccgttccagcagatgcaaaagcgcatcgggacgtagggctggcgattctcgtgagggtcgtcgttgcagatctgcggcgacaacatcgcattgctcatgacgacgggggctgaggggctcgtcgtcggcggcggcggattggtgtaggtcggagtcaccggattataggccagcacggcggtaggggtggttgtgccgttagtctcgaaatagcgcgataggtaggagacgccgggggtcggtgtcgccttgtaggatgtcgccgtcttcgcgtaggccgcggactcggcatagatgagatggttgtgcaagggaagccccgagtaggcgagctggactgtctcggtgccgccctttcctcccaaccgcaccgggctcagcgatgaagcgggggcaccctgggtcgtgagcgtgctctgtcccacggaagtggtgccgctaaggttcggaacggcaaaggttgtctggccgttgccgccataaagggtgccgacaatggccgccaaagcctggaattggccgatagagtatacgctcccatcgcaaagaagccagttttcgggggtgaaggtgtagggaaatgcgcgaatttctccaataaaagcgtcagccatgaccataactccctgaaatcgttaacccttagtggggaaaattccaccctcaatgcggatgatgtacatgaggccaagatatggcatgcggttctcatgcggctgggatgcccccgccgtggtgaccatactggcaccaagctgcttgggggtgatggtcatgcccgaagggatcgggttcggggtgtcgaaataggccacatgagtcccatcggtgaaactggccgggacaccgccactggggttcgggctgaccaccgggtcgccactggcattgagcgtgtgggtatggggggggatttgggcttgggtcaaggtgaccgtctcgacgccgccattggtggcaaagccatacggtgtcagcggcgcgctgttggacgccttggggtccacatggccggtgccgaagcccatggccaggcggctgcgcaggtccggcaaaccgaaggtggtggtgccattgccaccgaactgggtccccaacagggagaacagagccgggtattggctgacgctcagctggtggccgtcacacaccgcccaattgacgggggcatagctgccgctgaagagaataatctgaccgagatacgaatccatgatcttgcctcttcatttcatcagggacggggcgggtaatagccgctagtacaaatgcaatagccaagcgccaggtagggctgcgtgttggtgtgggccgcccctcctccgactgtgctgaccgatgctggattgagcggaacaggcttggtccccgagttgtagagacttttttgggtgccgttgtagatgggcacggccagatagttgtcgtcggccggattggttgcgccgacggtttggtcccccaccacctgatgctggtgagacggaagctgcgccgtcgtcagggtcaccgattcggtgccgccataggccccggtcacatacgagacgcctgtcaccgggttttttccctgccccatgatggtgcggccgcggagatcgggcaggaagaaggtcgtctttgcgtcaccgccgaattggttgcccagcagggagaacagggccgcattggcggatacctgcatggagcggccgtcacagggcagccagcccgtcggggcccagttcagtggaaaaaggcgaatctcgccaagaaatgcctccgtcatgtcacgctcctttttgatcgcaggtcacgcctgggatgttttggttgcaacgaagtgtcctataaggagaaaacaattgtgggtatgagtcaaatcagaaactgtgttgatacgtgacaactgaaaaattgtatgcataagtgtattggatttgtagcgggtgctatgttgcaagtgctacccgtattcgtatagctgttccccgggggcgtgccccggaggccgcatgccttcgccccattcttcggcttgcccccgggcctcacttcaactgattgtccctaacgtccggccgcgctatgatccggcccaagccctgcccatggagttccgctgatgagcgaccaatcccctcccgcgacggaagacgcccccgcccgcaagccctggcacaagccggagatcaccactctggcggtggaggaaaccgccaccaatggcagcaccggcaacgatggcagcggcgccaccacgttttcctgatttccatcacgagcctgatgttccatgggtgattttgccgggatgtggcgccttgacgggcggcctgtcgacgaggcggacctcacccggatggcccagggattggacggccgcaatgtcgcgccggcccgtatctggcgatcggggccggtcgccctggtccaccgtcgcccggctcggccattcactccgggggaggcgcgggagcttcagccgctgaccggggcttccggcgcggttctggtcgccgacagccatcccggcgccctgccgatcctcaccgccctggagcgccgtggggtcgacggtgtcctggaggggctttgtggatcgttcgccttcgccgtgtggcagccctccgagcgccgcctgacattggcccgtgacggtgcgggatttcgtaccctgttcctgcatcgcagtgaacggctgatcgccttttccacccgtctgcgcgccctgctgtccctgcccgacattcccctggatctggacgagcatgccctggcggccagcctgatcctcgaccagagccagccggaacgcaccatttaccgtgccattgatcgcgtccccatgggccatgtggcagtgctgaccgcgcaaggcacccgggtcagccgctggtggtcgcttccgcgccccggcaccctgcgccatcgcaacgattccgaggtcgaggagcatgcgcgccaagtgctcgacaccgtcatggacgacgcgctgcaggccgaggggccggtgacgtcctgcctgaccggcgggctggacagttccaccatcgtcaccaccgccctgcgtcgccttgggccgaggcggctgctggccgtcacccgggtccccgatgggcccactcccggcgataccgcctgcaactatcatgatgaatcgccccgggcgtcggccatggcggcgcttcaccctggtattgactggtatcccatctccggtgacggtggtgattggggcgagagcgatgccaggagatggcacctggaaggggggcagccgaccggggcttcggtcaatatcgcttggttctttcccgtctaccgattcatggaggggcagggcagccgggtcctgctgggcggcgagcagggcaacggctatttcagctattccgggctcagcctgttgccagagctgttcctggggttgcggtgggggcggctggccgggcatttgctggcgctggcccgcaacgaggggcgcagcgccgcctacttcttcaagcgggaagtgctgcggccgttcgagcccttgtcctggcggatgcgccggctcgggcgggggccatccccctggagcagccattcagcgctcaacccggccttcacccgcgagattcgcctggaccaaagcctggataccggccgttaccgccagcgggtggacggggggcaccactcgaccttcgaggctcgccgctggctgctctgcgatgaaaccgcccgtgacgtgcgcggcgtcctgcgcgccatgaccggcatggacctgcgtattcccctggccgatcgccgggttctggagtttttcggttccctgcccctggaccagttcctgagaaatggcgtcacccggtcactggcccgccgcctgttggccgggcaggtgccggccgagacggtgggaaaccgtaccgccggcacccagaacggcgactggttcacccgtctcagcgccgcccgcccggcaatgatcgccgacctggcccgcctgcgctcatcccccctggcccgccgcgtcatcgacctggatcgcatccagggattgctggaccactggccgcgagacgcggcggcagccgagcccaggaggcgggagtatttccacctgctgacgcgtggcctggacatggccgggtttctcgcatggcgggaaagtgccaataattgaccgctctttagccgtggctggttttcgaaaggggttcctgctatggtcgccggagcctagccgccagggagagccgcgccgtgaccatccgtccagacatgaccatcgtgcggtcgcccacgtgtctggccgccgaggttggtgacgaagtggtggtgatgagcgtcgagcgcggcctctactacgccttcgatgagatcagcagcgatatctggggccggattgccgaacctctcagcgtgcagagcctttgccaggccctgttgctcgattatgacgccgcccccgaggtcatcgagggggacgtcctggccgtcctgacccgcctgcgcgaagccggtctcgtcgacgtcgtggggtaacggccgatggcaggaggcttgccgatacccgaagcggtcaagtcccgcctgcgcaagctgcctggttatgccctggcgcgctcgtgctatgggatcatccgctatcccgaagagcggggaatcgccctggcgcgctatggcgggaagcgcaccatttttcagccctatggcacgacatttcccgaccgctatccgaagatattctctttcgtgcgcgatcgggtcggcgacggtgccgacatccggattctgtcctttgggtgttccaccggcgaggaggtcttttccctgaaatcgtggtttcccgccgcgcgaatcagggggctggacgtcaattcctacaatgtcaggacctgtcgccggcggtggcgccgggatggccgcgaccctcgtctgtcttttgacgtggcggattccaccgccagagaggcttcggaaagctatgacgccatctttgccatggccatattccgccatggacggctgagcgacgactcccgtcgctgcgaccctgaaatccggttcgccgatttcgagcgctcagttgccgacctcgcccgatgcctcaagccaggaggggtcctggtcatccgttacgccaatttccgcttcagcgacactgccgtcgccgcggacttcgagacgatgcagacctttcccgacggaccggtttcgccgttctatggacgggataattcccgcctggccgatggctccggggatgacggcgtgttccggaagaaatccggggccggggccacgcgatcatccgaccagcccaggccggtcgacggtcggcgttggtcgtcgttgccgcttctgatggaggccgggctggccttggcgggggcccgattgttgaccgttttgccgttcaggatcgccgtccgctgggcgggtcttcaccatcacgccgtttcgccccgggatttggggcttgtctcccgcatgccgtccgttcccgaggcggcggccatcggtcaggcaatccggcgcatcgcccgccgagccccttttcgcgccgtctgccttcagcaggcgctggcggcggcgatcatgctgcggcggcggcggcttccggtggagcttcacttctccgtggggcgggacggggcggggctccgggcccacgcccgcagtctcagcaaccagaccgtggtgaccggtgccgagagtggctgcgaccatcagccgatcgccattttctccgcgcccggagcaaaccttgaccgacgctagacggcgaaggggcatgctcttgggtgaaatctcatccgagacggcagccgcccagtttgtccggctggttcgcgacctgaccgccttcgccggctctcgcctcgctcttgtcatggcgggagcctcggtgatggccgcggctgagggaatcggtctgctgctgctggttccgcttctgggcctgctgggaatcaccggatcgcccggcatgctggccgaatggctgggcccgaccagcatcgaactcgctctggcgctctatgtcggcctgatcggcggggccgccatggtggtggccggttgcaccctggcggccagccgcctgcgcatggattatgtcgatgacctgcgatgccggctgcatcgcgcattgatgggcatggagtggcaagccttttcccgcctgcgaggggccgaggtcacccgggttctgaccgacgaggccgtgcaggcggcgcatggcgtccagtttctgctgaacctgaccggatggctgctggaggtcgcggtcctgatggccgtggcggcccggctgtcgctggtcatgaccgcaggcgttctggcgctggtgctggtgggggggctgctggcccggtctctccatcggcggacccacctgctcggcaaggaacagggccggaccggcaaggcctggcaggcggcgctggctgacaatctggcgggaatgcgcgtcatccgcgccttcggcatggaagggacccggcatgccgtcttcgtcggggccatgacctcattgcgggccacccagcgcagattcctggtggcggtcgccaccgccgccgtcatgacccgggcgggagcggcgatcgccgtggcgctggccctggtggtggcgacccgggggttcggcttgccgctggccgataccgccgtgctgctgctggcctatatccgtcttctgtcgacgttgttgaagattcaggagggctggcgggtggttctgctcgccttaccggcccatgccggcgccatggcgctgctggcccattgccgggcggcggcggaggacggggacgaacagcccccttgccccttggacctgcggggtgagatccggctggagggcgtcggctaccgtcattcggaggaccgtcctgccgccttgcgccatatcagcgcggtgattcctgcccggcggatgacggcgctgatcggggagtctggggccggcaagtcgaccctggccgacattctgcttggcctgaccgtgccctctgaaggctgccttcgcgtggatggcacgattctcgacggagcgctgcgccgccagtggcggagccgggtcggctatgtgccccaggatggcttcctgtttcacgacaccatccgcaccaacctacttgcagccgctccccatgcggatgaaccggcgctctggcgcgcgctggagcaggcggcggcggccgggttcgtccgccatttgccgcaggggctcgacacggtggtgggcgatcgcggcgcccggctgtccggaggcgagcggcaaaggctgaccctggcccgcgccttgctgtcgaacccggcgctgctgattctcgacgaggcgaccagcgccctggatgccggcagcgagcggctcattcttgatgccttggaccatctgcgcggggagctgaccgtggtggtgatcgcccatcgtccgtcgatggtggagcgggccgatcacgtgctggttcttgagcaaggacagctcgttgccgccgggacctggacggaggtcgggggtgcggtcgatggtacgtcgcacctgggcacggccccggcataggcttgcggtatttctattccgccgcttcccatacataggtaagatcgtccttatacggcttccggggtttcccctgccgtacggccgtgggggtgtttttccccgatctgcgctgcaagagtttcggtggggtgagtatctctgtgacggaccgctttcttgcaacattgagacggaccgaagtgctgtgccgtgacggcgacaccgtgctgtggcgggcgcaggcggaagatgccggcgcggctttggtgcgtgttgccgccgacgaggtgccttcggtacgggtggcggcgcgtcttgcccatgaattcggattgaggggctgtctcgactccgattgggccgttcgaccccaacttcttgcggggcagggcggtagggcggaactggtgctggaggacccgggcgggatcgtcctggacgcccttctgcgccatcattccaagtcccggtcgggcgagaagggactggccgtcgagggctttctcgttctggctctacgcatggccgaagccctggcgaagctgcatgccgccggtctggtgcacaagggcatcaaaccgggggccatgctggtggctccggacggtgactccatccgtttcaccagtttcggcttcgcgtccgtgctgccgcgccaccagatgccgcccgaacccatcgaatccatcgagggtgacctggcctatatggcgccggaacagaccggacgcatgaaccgctcggtggattgccgcagcgacctctattccctgggcatcgtctttttcgagatgctggccggcaggctgcctttcgattcaaacgatccggccgaattggtgcatttccacgtggcccggcgtcctccgccgctgtcgcggtttcgcgaggatgtgccggtagtcgtcctggaaatggtcgccaagctgctgtccaaggcggcggaggatcgttatcagacggccaagggactagccgccgatctccggatctgcctggaggactggcgcgggaccggggctatcgcgccgtttctgctgggcgccaatgaccgtcctgaccgtctggtcattcccgagaaactgtatggccgcgaggccgaattgcggcaattgctcgatgccgccgggcgggtcacgggcgacggcgcgctggaggtggtcttcgtcgccggctattcgggcatcggcaagtcggtcctggtgggggaattgcaaaaggcgctggtcggctcgaacaccttcttcgccacgggcaagttcgaccagtacaagcgccacattccctatgccacctgggctcaggcctttcagggctgcgttcgccagatcctgggactggacgacgcgcgcctggtcaaatggcgccttgccattctcgatgcggtcggccagaacgggcggctgatcaccgatctgattcccgatctggccctgctgatcggcgagcagccactggtgccggaactgccgcccaacgaggcgcagcaccgttttttcaccactttccgccgtttcctggcccgctgggcgaccgagcgccatcccctcgtcctgtttcttgacgatctgcaatggatcgaccccggcagcctgaagctgttggaatatctcgcaggccggtccgagctgggccacctgctgctggtctgcgcctaccgcgacaatgaggtggggcctgcgcatccgctgaccctggccaaggatgccatccgcgcccggaccaggattgaggagatccccctgcgaccgctgtccaccggccatctacggcaacttgtggcagagacattgtcgtgcccggcggcccgggcgcagcccctggtggagatcatcggcggcaagaccgggggcaatccgtttttcaccatccagttcatgcacggtctgttcgaggaacaactgctcagccccggccccgagggctggcaatgggacatggagcggatcgccgccaagaatttcaccgacaatgtggtcgatctgatggtcggcaagatcctgcgcctgccggaaaagacccaggaggtgatgcgccggctggcctgcctgggcaacatggtcccggttcgcaagctggccctggtccatgacggggccgccgagaccctcgatgccgatctgggcgacgcgttgcgcgcctcctacctggttcgccgcaacgataccatccacttttcccacgaccgcatccaggaggcggcctattcgctgctgcccgccggggatcgtccggccgagcatttgcgcatcgcccgcaagctggccgccggactcgatcccgccgggttcgacgatgccattttcgagatcgtcggccatttcacccagggggtcgagctggtctcggatccggaggagcggtaccggctcggccgctggtgcgccctggccggagagaaggccaaggcctcggccgcctatgtgacggcgcagaccttctttgtccaggccatggatctgctgccgcccgatgcctgggaccacgattacgaccggacgctgtggctgtatctcgagcgcgtcacctgcgaattgctgctgggcaatttccagcaggtggatgacctccttccgttcgtcctcgaacggacccgcggcaacgccgaccgggcccgggcctaccggttgctgatcctgcgtaatcaggtggcgggccggtatggcgacgccgtggacatcgccctgaacgtccttggcctctttggcctggactgcccggcgtcgcccgccgaggtggaccaggccgtcgcccaagggcggcgtgaggcaagcgccaacctgcgcggccgcgagatcggcgccctgatcgacgctccggccatgaccgatccggaggcgctggccatgatcggcattctggccgattgcctgccatgctcgtttctggcccggccggatctctacggctggctggccctcaacgggctgaatatcaccctgcgccagggcaataccggtgattcgtgctccatctacatgggttacgccatcgtcctggtcagcgagttcggcgaaatcgacgaatccctgcaatacgccgaccttgccctgaagcttcaggagacgctgtcgcgccctgacctgaagggccgcatcctggtgcgcagtggggtcttcatcaacagccgccggaattctttcgagtcgagcatcgagatcctgcgcgagggattcgtcgagtgtcaggcggcgggcgactattcctatgccgtctatggcgccctggagatgtgctggctgaccctggaaagcggggctcatctcgacgagctggacgcggcgtcggtgacctattcggcctttgccgaacagagccggaatattggactcctgaatgccttgcgggcccagaaggcgtttgtttccagcctgaccggtgccctcgaccccaccgggtatctggagaacggcgcggaattcctggcggctttgaccggcgccaagttcggcaccggtgtcgcctatttccacctgatgggccaaatggtagccctgctgcgcggcgagtaccttcaggccagggaccagagcctgaaggtcgccgcatccctgaaaagcatcaccggatgggtggccgagaccacctaccacctgctggccgttctgacattgtcgcagctcgacctccccgtggaggagcggcggcaggagatgctggggcatgtggacctgttgcgccgccgggccggcgacagccccaggaactacggatgccggtactctctggccctggccgagctggcgcgcctggacggggatgtgctggaggcgcagcggcgctacgaggaggcgatcgcctcggcccgcgatgggggcttcctccacctggaggccatggcctatgaatccgcctcccggttctacagggaacgggaaatggccctgatcgccgaaacatatcttcgcaaggcgcgggattgctacgcccagtggggggcggtggacaaggtaaggcggatcgagagcgagcagcccgaactcggtgcagagcatatccagtccgccaagggaagcgaaagtccggctcaggcccaaaatctcgatgtcatcagcgtggtcaaggcctcccaggcggtctcgggggagatcgcgctggaccggctggtggaaacgctgttgcggatcacggtggagaatgccggggcgcaacgcggcgcgctgatcgtcgacctgaacggtacgccaacggtggtggcccaggcccggatcggtgacggtgcggtgtcggtcgagtcccagcgcagggtgcccaatggggcggacctgcccgaaaaggtgctgaactacgtccaccgcgcctggaagcgtgtgctgttggacgacgcgttgcaggacaacgatttcagttcggacccctatctcagggccggtaaggtccgctcggtgctgtgcctgcccatggtcaagcaatcgaggcttatcggattgctgtacctggaaaacagccacgtttcccacgtttttaccgccgatcgggtagcggttctcgatctgctggcctcccaggcggccatctccctggaaaacgccctgctctacgaggatctgcagcgccaccgcgacgacctggagcggacggtggccgagcgaaccgcccagttggtcgagaagaaggagcaactggacaagattttgaacgagcaggaaatcatcctggaaaatgcgtctctcggcatcgtggtcgtcaagctgaccgccgatggccgccgggtgatccagcgggccaatatcgccgccgggcgtttgcttggctatgctccgggggcgctcgaaggcatggagacgcgggcggtctggaccagcgaggaagacttccggctggtgggcgaggcctacaagctgatggccgagggccagacctatagcggcgagcacgccattcggcggagaaacggcgagaggggggtctgcaagctggtcggggcggctgccgatccgtctgatctgtccaagggaaccatctggctgatcgaggacattaccgaccgccgcgccgccgatgcggcgctccgggccgccaaggacctcgcggaggaaatggccgccgccttccgcgacaaaagcgagcaggtggccagccttctcgataattccggccagggcttcctgtcattcggcgccaatctggtggttgattcccaatacagccgggcgtgcgagaccatgctgggccagtcaccggcgggcaaggacgtggccagcctccttttcccggatgaggctgcaaaggctgatctgctgcgtcttggcgtcccggaggctttgaaggagcgagagcccttcaagcgggagctgtacctgtccctgctgcccaccgaggtccggctgcgcgacctgatccttgcgatcgagtactcggtgctggagagtgggcacctcatgctcgtcctcaccgacatcaccgaggagcgccgtctggaggacagggttcgcagcaatcacaagattctccagatggtggtcacggcggtcaccgacagccgtgacttctttgactccgtcaatgccttccgtcggttcacccaggccgagatacccgcgctggcccattcacccctgccgccgtccggggtgttggaagggttgtaccgggaggttcacaccttcaagggcacgctgaaccagtttagtttccaatacacgcccgaagccctgcattgcctggaggggcgccttggcgagatgcgggcacggaaggatggcctttcggccgacgatatccgcgccgcggtcgccgcggtgccgctggagccacccttcgagcgggatctgagccagttgcgcgagatcatcggggacgacttcctggaccggggcgagcggatcaccctcacggcggaacaggtcgtccagctggaacgcctggcctccgaccttttgcgtggtgaggcgatcgacacggcggtacccgagatcagaaggctgctcgtcgagattggctttctgcgcaagactccgctgtgtgacaccttgtccggacatcgcaatacggtggcgcaggtggcagctcggctggaaaagaacgtggcccccgtcgagatctcgggtggcgaggatatatggattgaccccaagacctttgccccgttcctccgctcgctggcccatgtcttccggaacgccgtgacccatggcatcgaggacccggattcgaggctgctggcgggcaagaacgaaagcgggcggatcacctgcaaggtcggccggaccgccgattccatccatctgagtattgccgacgatggggtgggtatcgatcagggcgccgtcaggaccagggtcgtggaagcgggcctgatgccggccgaagcggtggccgccatgaccgaggcccaggtgctcgacctgatcttcctggattccatgaccaccaatgtccacctcgaccagttctccggccgtggggtcgggctggccgccgtgcgcgccgaaacggcaaagcttggcggaacggtggcggtccgcacccgtcctggacaggggaccgagttcgtcttcaccctgccgttccagggcgaagggcaggggtgagctgaccggccgcaatccccgctctgacattgccagagtggagaccgcggcgcgaactcagtattccttcttgttttcccacatggattcgttgaagcgcaccacccggttgcggccattttccttggcctggtacagggcgacgtcggcgaacttcaccgcctgccagaaggtgtcgctgtcggtggggaagtcggacaggccgatggaaatggtcttgcggatggtcaccgttcccgtctgcaccaccagggcttccaccagggcacggatcttctcggcgacctgatcggcttcggccgacggcgtgtcgaccaggacgatcaggaattcctcgccgccgaagcggatcaccagatccgaggcccgaaccgcctggcgcagtaccttggacagggccttgagcaccgcatcgccggcatcgtggccataggtgtcgttgaccatcttgaagtggtcgagatccagcatcatcaccgtcagggcggatttgcgccgatggacgttggccaccagggtgtcgacgtattcttcgaggaatcggcggttgttcagcccggtcatgggatcgctgagcgacgattcccgcaaggtctccatcaaccgcttggtctccagcaccggagcggcctcgcgcagatagacgttcacgtagggaatcttgctgagcaggtgctgctcctgcccctcggaggccaccaactgcaacacgttgcccaccgagccggactggatgatgggcaggcagatatgcttgtagccgctggtgtcgttttccggctggaaggcgtagcagatggccgggttggtgacgccatcgaccatgtggccggtgcgccgcgcgcggcagccctcgctgcgcaccaggatctgcgggtcgcaccaacggcatgaactgtcggggacgccgtccacgaacagcggggtcatctggttcttgttgggcacgatctcgtagagcgagaaggtcttgatgccgaactctccatccagggtccgggccaggcgctcgtggatctcggccttggtctcgtcctcctcgatggcctgcttgaagcgggcggcgcgcgacagcccgtccaccatgtcgatggtggcgttcagcaggttctcgtcggggctgggggtgcggttggtcaggcgggcgacgctgtcgccgatgcggttcaggccgttgtcgagaaaggccagaaggcggttcatgtcggcggcgatctggccgacctcgtcctcggtccgctggctgacctggcccttgaagtcgccgcgaagcgcccgctggaccgccagttccacattgagggcggtggtcgagaccggctggatgacgcgccggatcaggaagaaggtcgcggcgctgaacagcaccacgattccgacgattccggcgacggtcagcagggccttggacttcaggtcctcgatggacatggacagcgtcaccgcgcccagcaccgcgccttcctgcacctgatggcattgcaggcagttgggcgagccgcgggtcgaggcgacgaagggaatggtgccgcggaagatggtgccgttggggctttcctcgacgcggtagacgggcttgccgtcgtggagaacctgctgctccacctcatcgttgggagtctcgcgccccaggcccttgccaaactgctgctccaccaggggcgagcggaccacctgggccgaggtcaggccctggacgtccatcaggcggctgagaaagctttcccgcttgtcgatgacgccgttgatcatggattcggtcaggtggacgcgaacgatttcggcggcggtgcggatgtggtcagtggccgacgcgatcgaaaacgagcgaaaggcgtacagattgatcgccaccagcatgaagaccaagctgacggccatggccacgaaaaacatcgtgacctttgagttcaagctcataatccgtgacttcccccaagatgctgcaggcggaatcggcataagacccccggccgattcaaaagactcactggttgctatcatctatgttcaatgcatctttaggtgcattgctcgtcataatactgtcagggagagaggctggcaatcgtcggcgcattcagtctttgggccgcctgtccggtcggggaggagggcggtgacttctccgtgacccccgtgctacattagggttgtctacaccgcccatggcggcaatgcggggattgatggctttcgttccgggcaaggcatcggtggttgcggcacggcggacctgcatcaggcggcttgccgcctgggcgggcgtgctggccctggtgctgcagattctgctgccggccggtcaggccggcgccgcgctgtcggtggatcaggaacttgaagcctccatctgccattccggcgaggccggcggcactcctgtttcgtccaaggtcgtccacgatcattgccagtactgccagattcacgccggcgccaagctcctgctcgcgccgctgtcgtggagcgcggcccccatcccgccgacgccggtcgtcgtcgcggcgcccgtggagggggccataccgggtaatcccggtcatcttccccatccccaacgcggccccccgtccttctcctgattcctgtcgttgaagcaggcgggctggagacgggatcggtgcgccctgatcgcatcgctctggacgggtctcggcctcgccctgctggtgaagacttcatcccgttgatgacttgagttccataggagagcgtaatgaaccgtcgcaagttcctggccgccggcaccactttgggtcttgccgccaccctggccgttcccgccgtggccgccgagggggatggcacccccatgcagttcacgcccaagaagcccaaggacccgactccgctggtcgatgaactggccaagtaccccaagtgcccctattgcggcatggatcgcaccgagtaccatttcagccgccatctggtgcactactcggacgatctggtggacggcacctgttccctccactgcgccgccgtgtcgctgtcggtcaacctggaccgggtgcccaaggccatctacgcccctgacaacggctcgggcgaggccgtcaagccgctgaccaatgccgaggccgcgacctatgtcatcggcggcgagcaccggggcgtcatgaccaagaagcccaagacctcgttcgccgccaagctggccgccgaggcggccaagggcgacggcgagttggcggacttcgacaaggccctgatgctcacctatatgggcatggccgaggacacccggatgatccgcatgaagcgcgatgagcgtcgccgcaagatgatgggcgagcatcagatgcacaaaggctgatccggccttgggggaggccgtcggcctcccccgctttcatagggaaatgtcatgagtctgcttgccgtctcgccgcctttgctcgtcctgcctcccgtcacgggcgccggcggatgagggctgtttccgttcccgaggaggagatgtgggcggcgttgggcgcccagttgggcgatgccgggatcggcggtgagttgcgggggcgcgccgggctgttgtctccctgcgccgtcatcttgccccgtgaccagatcgacggtctggcgcgggcggttgcggccctgcatgccgtattctccgcaccacccctggcggttgcggccatggaggtcgcccggggcgaaagcctgcccgatcacggcctgggcggctggatgctgggcttcgactttcatctgaccgaggacgggccgcgcctgatcgagatcaataccaatcccggcggcatgctggcggtggcggcccaggcccgcgccctggtcgcctgccggcccgagctgggccagccccccgaggtcgaggccatggcgctggaggcctttcgcgatgaatggcggcgccagcgcgccgggcaaggtctctccagcgtggcgatcatcgacgacgatcccgccgaccagtacctcgccccagaattccagctgtatcgccgcctgttcgagcgggccggtcttcgagccgccatcctcgatccgggccagtttcgcgcgggctcggccgacatggtctacaaccggctggtggatttcagcctggactcccccgcccacgccgccctggccgaggcctggcgcagcggcgagacggtggtcacccccgatccccgcgcccatttcctttattccgacaagcgggtgctggcgctgctgtccgacggcgaggccctgggggccatggggattggcgccgacatcgccatggcggtcgccgccatcgtcccgccgaccattccggtttccgccatcaatgccgaggaattgtgggcggggcgccggcaatggttcttcaagccggcaaagggccatgccggcaaggcggtctatcgcggcgagaagctgtcgcgctccacctggcccaccatcctggcctcgccctatgtggcccagcgctatattccgccgccgcgtctggcggtggcgcatgcgggcgccagcctgaagatggatatccgggttaacgcctggcagggccgggtcgttcagatggccgcccggctttacgagggccagaccaccaatttccgcacgcccggcggcggcttcgccccggtctttcccgagccatgaggcccaagacggaagacgggcggcgcggacccggctatccttggcgcccgaggccccacggggggcggaggcaggagttgcttcaggcttgacgctttcgtttcagtccgtccagatctggccgccgccctggccatttccgttgcgtcccagcctcgccgcctgggccgagcccctggtgcagccggagatcatggaggcagcggggcttgccgccgccaccctggtcctgcttgccgccgcgtggtgggtccgccggctgcgctggccgcttctggccgccgccggcctctcggcctggttcggcgcgcccggcctgggcctgctgctggtgccggcctatcccaccagctttcacacctcgcccaccggctttaccgccggttcggtggccagaggacaggcggtctatgtccgccactgccagagctgccacggcccggaagggcggggcgacggacccgaggcgtcccggcaggcggtgccgccggccgacctcgccgccgagcatctgtgggatcatcccgacggcgacctgttctggtgggtcagccggggcatggtggcggtcgatgggcgtccggccatgcccggcttcgccgacaagctgtccgataccgagcgctgggaggtcatcgacttcctgcatgccaacgcggccggggcggaactggcccgcaccgggctgtggccgcatggcttcatggcgcccgacatggccgccacctgcggcgatggacggcgtacctccctgtcccagttgcgcggagcccccgtccacatcgtcgtcgagggggcggatggggtggcccagggcggaacctcgcccaccttggtgatcggcggcggccgtccgtctgcgtcggtctgcgtcgtcgacgatccggcggcgcggcaggccctggccgtcaccctggggctgagcgccgacgacatcaccggtagccagttcctggtcagtccggaaggctggctgctgggccattggtatcagggcggtgcgcccgccgccgacagcctggtcttcgtcgccgagaccctgcgcaatgtctgcctgtcctccccggcccgctcccatgccagccatcgctgacggcgcctaaccgggcattgcggtctggtgctgcccgtcataaaaaaggcgggccgcctgttggcttcggagcgacgcatgaccatcaatatctgccacgtgggctacaacgaacataagcccatcttcgacgatgtcatcgattccctgcgcagtgccttttgccgtctgggagttcctcatcgttattcgctgaattacgtcgatcccggggccatcaacctgatgatcgggcacgtctccttcatcgagaagcgggagcttccgccgggtgggctgaagaacaccatcatcttccagctggaatccctgaccgaaggctccctgctcgagaagtgcccgtattacatcgagttgctgcggcaggcgacgcagatctgggactactctccgaccaatgtcgccttcctgaacagccagggaatccatacggcgattcacgtgccgatcgggcatgaccccatcctcgaacggatcgatcacgtggaaaaccgcgacatcgacgtgctgttctatggcgcgaagatgccgcggcgcacggccatcctgcaatccctcatcaatgccggctacaaggtcgagcatatcttcggcgtgtatggcggcaagcgtgacggctatatcgcccgctcgaagatcgtgatcaacatccaccagttcgacaagcaggtggtcgaggaggtgcggctttcctatctcctggccaatcgctgcttcgtggtgtcggaggtcgcggaccgcgacccctatgacggcggcgtggtctttgtcccctatgacaagctggtcgagacctgcgcccactacctgaacccggccagcaaggccgagcgcgatcgcctggccgaacgcggccaccaggccatccaggcttatcccttctggcgtggggtgcgcgcagccctgctggccaaggggggctttccccaactggcccaggagcgggcggaatgggggcagtactggactacgccggcttgaccggctcgtccaggatgcgccgcaattcggggatcagcctgtcttgccaatggggccgctcggccccgaccagtcggtcgaacttgccgcaatcgagcagggaattggccgggcgggccgccggcagcccgtaagccgcggcggaagtggcctccagcggaaccgggccgatgcccgcccgggtcagctcggacaggatcagggcggcgatctcgtgccaagaggcggcgccgccggcggcgaagtggtaggttccccgctccagggactggcgcagcatcttgtcggccagggccaggacggccgtagccacgctgtcggaatgggtgaggccgccgatctggtcgtcgaccacccgcaaggggcgtccggcccggatggcgcccaccatggcgcggacgaagtcgccccgttcgccgccgtacagccacgatacccgcaagatggcgtggtcgggctgcagccagcgcacggcctcttcccccgccgccttgctggcgccatagacggaaagcggcgccatgggggcgtcctcgcggtagggctcgggcgagcggccatcgaagacgtaatcggtggacagatgaatcagcgggatgccccgggcggcgcaggcgcgggccaaatgagccggcccttcgccattgatggccatggcggctgccgtctcggtctcggcgcgatcgacggcggtgaaggcagcggtgttgaccaccacggaacaggcgtggagggtcaacagccggtccaccgcttgcgggtcggtgatgtccaattgctgtcgccccagcgccgtgagggtcgcgccctgcgggagtgcggcccgggccagcgcgcgtcccactcttccgtcagccccggttacgagaatgtgcatcagccgccatatcccccgtcagacctgccgggaatttctccgactggtgcccatgtccatattgcgtctatatagaccgggagaaaggaggagaaaacatgcttgtggttgagagtgatttaccgggtgtccttctgctgcggccggcccgattctccgactcgcgtggctggttcatggaatcctggagccatcaggcgttccgggaggccgggctggacaccgaagtcatcaaggacaatgtctccctgtccttcaagaccggaacggtgcgcggactgcattttcagcgcccgcccatggcccaggccaagctgatttccgtctatagtgggcgcgtcctcgatgtggcggtggatttgcggccgggctcagccacttatggccgccatttgagtgtggaactgtccgccgccgaggggaccatgctgttcatccccaagggattcgcccacggcttttgtaccctcgaggacaataccctggtgggctacaaggtggacgcgccctattcgccggagcatgagggcgccatccactggcgcgaccccgatctgggcatcgtctggccggtctccgaggatcaggccgagctgtcgcccaaggatctggcggccggtcccttcgccgggcgcgatcacaccgccagataggtgttccggacctcctcgtcggccgacagctcggccatggtgccgtcaaagcagatgcggcccttctcgatgatataggcgcggtccgagatcatcttggcgaagtgcaggttctgttcggagatcagcaccgcgaggccttcgttcttcatggccaggatggcgttggccatgtcctcgacgatcttgggggcgaggccttccgagggctcgtccagcatgatcagcgagggattgcccatcagcgagcgggcgatggtcagcatctgctgctcgccgccgctcatgcggccggcgccgcgatcgcgcatgccggccagattggggaacaggtggaacagccgctccttggtccaggtgggggcgccatcccggggcggttgggtgcccacgtccagattctcctccaccgtcaggtcggtgaagatgcggcggtcttccggcacatagccgaggcccaggcgcacgatgtcgtgcacgggcagggcgctgatgtcggtgccgttgaacaccagttggccggtgcgctggggcaccagcccgaccaggctcttgaaggtggtggacttgccggcgccgttgcggccgatcagcgccaccacttcgccggctccggccttcagccccacgtcgaacaggatctgggcgcggccgtaaaaggcgttgaggttatgggcttccagtttcatgccgcacctttgtgcttggaatcgtcatagaccgcgccggtacccagataggtggcctgcacctcgggattggcgcgcacctcttgcggcttgccctcggccaccacatggccgcggctcaggaccatgatgcggttggcgtgggtgaagaccacgtccatgtcgtgctcggtgaacaggacgctgatgccgcgctccctgacgatgtcggcggtcagctgcatcagctcgatgcgttccttgggcgccatgccggcggtgggttcgtccatgagcagcagcttgggcgcgttggccagggccacggccagttccacccgcttcaggtcgccataggccagcacgctgcacggccgcgacgcctgggcctccatgcccaccagttccaggagctggaaggcctcgtcctgatagaggccgccggcgaagggccacagggcgcgcagccggttgtggaacgagatcagtgccatctggacgttctccagcacggtcatggagccgaaggtggcggtgatctggaaggtgcgtcccacccccaggcgccagatctcgcggggcttcttgcccaccagttcctcgccgaacagcttgatgctgccggcggtgggtggaaactggccgttcagcatgttgaagcaggtgcttttccccgcgccgttgggaccgatcagggccaggatctcgcccggcgccagatcgaaatccacgttggtcacggcggcgacaccgccataattcttggacagtccgcggacggacagggtctggttctggctcatgccgcgtcctccttgggctcggagcgtgtcagtcggccctggacgaagccggagatgccctgggggaaggccaccaccagcacgatgatgatcacgcccaaggccgtccgccactggtcggtatagctgctgatggtcacgtgcagggtcttgtagaccagggcgccgaccacgggaccggtcagggtctggacaccgcccagcagcaccatcaccagcccgtccaccgaggtggcgatggagatggtgtcggggaacacgctgcccttgaggaaggcgtagagcgacccggcgatgccggcgaagaacccggccagggcaaatcccgcccagcggtgggacgacagattgatgccgatggaatcggcccgcaatgcggagtcgcggcaggctcgcagcgtatagccgaagggggcgaaggtgatgcggcgcaccgccaggatgccgccgccgcacagggccagggtcaggtaatagaaggccaccggattggccgcccaaggcgcgggccagatgccgatcaggccgttgtcgccgccggtgaagctggaccactggaacaccaccgcataggcgatctgggcgaaggccagggtcagcatggcgagataggcgccggccagccggacgcagaaccagccgaacaccaatgcggcggcggcggccagcagcgggccggtgaccagggcggccagcatgggaatgccgaaatacttgaccatcagggcggcgccatagctgcccaggccgaaataggcggcgtggccgaacgacaccatgccgccggttcccatcatgaagtgcagcgaggcggcgaacagggcgaagatcagcacttcggacgccaccgaaagcccgtagctgccccccaccatgggcagggccagcagcaccaccagaccggcgaaggcgacgttgcggccccgctgggtcaacggccggatggggcgctccactccgccgccgccgcgcatgaccatctcgggcttgcccagcaggccccagggccggaccaccaggatcaccgccatcaccaggaaggtcagcaccagggtcagttgcgggaagatcaggatgccgaaggcgttcaactcgccgatgatcaccgccgccaggaaggcgcccagcacgctgcccagtccgccgatcaccacgatgacgaaggcctcggtgatgatctgcaggtccatgacgtggttgacggcctcgcgcggcaactgcaccgccccgcccagaccggccaggaaggcgcccagggtgaagaccgaggtgaacagccaggcctgattgactcccagcgccgcgaccatctcgcggtcctgtgtggcggcgcggatcagggtgccccagcgggtgcggtggaacaacagccacagcagcccgagaaccaccggccccaggatgatcagcacgaaatcgtattggggaaaggactggccgaagatgtcgatggcgcccttgagaccgggggcgcgcggccccagcaggtcctccggcccccacagcaccagcaccagatcctggacgatcagcaccagcccgaaggtggccagcaattgcagcagttccggcgcctggtagatgcggcgcagcaggaccatctccaccacggcgcccaccagggcgacggccgccgccgccagcacgatggcgccccagaagccgaagacggtgccaccgctgagcttctgcaccagggtgaaggccatataggcgcccagcatgtagaacgagccgtgggcgaagttcacgatgcggctgacgccgaagatgatggacaggcccgaggccaccaggaacagggacgacgccgaggcaagcccattgaggaattgaatgaagaagaagctcactgggcgctctcctgtcggccggaggtcgggggaggaaagggggcggcgggccttgtcacccgccgcccggcgtcaggctcagttcttgggacgcgccttggccacctcggccagggccggcaggtaatcggcgccgttggcatagtgccaatcgaccatcatgcccttgccgtccttcatggcggtcttgccgatatagccgcccatggtggactggtgatcctcggcccggaaagtgatggggcccagcgggctgtcgatcttcaggccctcgccggcggcgatcagcttgtcggtatcgaccgagccggccttgcggatcatctcggccaccgccttcatggtgttgtagccgaccaccgagcccaggcgcggataatcgttgaacttggccttgtaggccttgaggaaggcttcatgttcgggggtcttgatctgctcccagggatagcccgagacgatccagcccgacggcgtctcgtcgcccagcgggtccaggtattccggctcgccggtcagcaggctgaccaccgaacggttcttgaacaggccgcgggtgttgccctcgcggatgaacttggtgagatcggcgccgaaggtgacgttgaagatggcttccggctcggcgcgggccagggcctggaccgtggcgccgccgtcgatcttgcccatggcgggccattgctcgtccacccacttgatgtcgggacgcttggcgctcatcagctccttgaacacctttacggccacctggccgtattcgtaattgggcgccaccgtggcccaggtcttggccggcagcttggcggcctgatccaccagcatggcggcctgcatgtaggtgccggggcgcaggcggaaggtgtagcggttgcccttttccatggtcagggcgtcggtcagcggctcggcggccacgaagacaatcttgcgctggttggcgaagtccgagaccgccaggccgatatgggagaagaaggtgccgaacaggaccgagacgttctcgcggctgaccagctcgttggcggcggtcaccgcgtcgcccggcttgccgccgtcatcgcgggaaatcacttccagcttcttgccgttgatgccgccggcggcattgatttcgtcgagcgccagttgccagccgctgcggtagggcagggtgaaggcgggcagagaggtgtaggagttgatctcgccgatcttgatggtgtcggcggccgacgcggtgcccatctggctgccggccatcagggcggccagggcaaagctcttcaatacggttctgcgatccatgaaaccctccttgacgtgtgtcgacaccggtcctgcgtcagcgcaggccgtcctcacccttgatctcactcactgtcaggcctcccacgcgcggcagggggcgtcctgaatcggtgaccgccacggcgaccacgatctcgttggcgcggggcgcatcgggcactcgcacttccatggcgtcgaaatggctgcgcacgaaggcggcgtccttgtgtcccagcggaatgtcgatgggagcgttcatgccgccccgcttcttggacgacggcaccagggcggcgcccttctccaccgccttgcgcaggggcgcgcccagcttggggtgaagcagggcggcggcatgctccagctcgccgttttcgcccaccacggcggccttgccgtagctttccacctgggcgggggcgatgcccagcgcctccaccgccttttgccccagcagggcgcccaactcctcgcccatggcgatcagctcggacaggtcctcctgataggtcccggcgaagggattggcgatgaccgccacggcggccgccttgcgggtggggggctcgacggggcggcccatctcggagcgggtctcctcgaccaccaccacgatcttgcggatgcgggcgctcatcgtaatccgtcctcgcccttgacctcggaggccttgaggccgccgacccgggcatggatgcgcggacccgtggtcatcaccagcaccaccaccatctcgtcggagcgcggcgcgtcgggcacgcccacttccatggcgtcgaaatggctgcgtacatacgaggcgttcacatgggtgaccggcacgtccagccgggcgcccaccgcgcccaccttcttggtggacggcacgatggccttggcgtcgcccaggccttcgcgcatggcgtagccgccggggacgtgccacagggcgccgtgctccaactcgcccgcctcgccgacgatggcgcccttgccgtagccttccacgatggagcggtcgccgcccaggatggccaccagacggtcggccagttccaggcccaggggctccagctccttcatggtcccctggatgtcttccacatagcggccggcatgggggttcttgatcaccgccagggcggcgacgcgcagcagcggcttggcggccacgggaccgccttcatggaagatctcttccttgatggtgacgattttgcggacttcgatcatggctgtgtccttattggccgatggcgattttcaggtcttgggaaagctccccgcttccggcgaagcgggtttggccctgcaggcaaaggcaggcggcatggatcaggccccggtcgatcatggccttggccaccgccgttccggcgtccagggcgacaccggccagggcggggggaaggggagagaccgacacggtgaccagccgctcgcccaggtcgctgtcgggggccagatcgcgggcgggctggcggcggatggccgggtgctccacatcgaccgcgttggcgatcagggtggcggcggcatcggcggcggccgcgtcacgggccagcacggtgaccgaatcggcgatgcccagcgagaacgagcgcccgccccgtccgctggtggcgatgccgcgcaccggcagatcggcggtgacggtcatcctcccgtccaggctgggatgatcctggtccgagaccatgcccacggtgaaatggctgccgggtgtaaggtgcagcgcgatatcgccgccattgttgacataggcgcgctccagccggcgatccttgaccatggcggccaggatttcgtcggccacggagcccgccaccgccgccatgggggtgatgaaggtggcgcaatggggccgcacggcggccagcatgcgccgggccaccgggccgaatagcgccatgctgggggtagcggccgaccgcagggtgggaagttcctccaccagccggggcaggagggcgggaaaggccgccgccgcctgggcataggctgccgccacctccacctcgccgccgaaggcctcgacgatcaggtcgatggggccgtgctggaggtgcaggcgcttgccgtcgggcaacagggcggcaacgggcggggtcacgtgtcgtccccccacttgtagttccgcttcagcatgggccagggattgtccgggtcccattgcaccgatttgcgccgatcctgattgatgacctgctccagccgcaccacggcatccatgtggccgcccagggcgcgatagtcgtcgaggcgcatggtgaactcgatgggcgccaccaaagcgggggtgggcacggcgccgaacgagtggtcgggcatgcgcagcacgtcgaccatgtaggtgatgccgccgcccggccagacatagaccggggcgccgccgctggtgaccagggtcagtgagtccttgaccgagcgggtcagcttgaccgggttctcggtgaccccggcccgcagcgagccgcccgctccggcgatgaacaccaccgagcacagcgccgcctcgcaattctcgcggatgcgctccaccgtggcggccacggcggcgggcatctcggcctccaccggcttcaggtcctgatccaggacgtaatagccggcatgttcgccggtggtgctgaccatcagcaggcgatggccgggcttggccaccttgggattgaatgggtcgaggatggacagcgggtcggtgatgttggtgccgccccagccggtccccggctctgccacctggaaatagcgccccagcgtcgagcggcggccgcggatcaccgcgccgctgtcctcgatgccgagatagcgtccggccttgtgctcggacagcaggccggtgatgtggtcgtcgaccaccaccacctcttccaccagcccgaaccattgcttggcgaacatgccgatggtggccgagccgcagcccacccgcatgcgttcctcgacggtgccgttgacgatgggggcctgacccgcctggaccaccacggtggcgccgttatcgatggtcagctccaccgcctgcttgttgcacagcgccagcatggtgtcgcaggtgagcttgccctccttcttggagccgccggtcagatggtggacgccgccgatggacagcatttgcgagccgtactcgctggtggtcacatggcccaccgcctcgccgcccgccctcaccgtggactgttccgggcctaagaagcggtcggtgtcgatcttcaccttgacgccgcaatagctgaagatgccttcggtcaccacggtgaccatgtcgacgccgtcatgctcggccgcgacgatgaagggggcgggcttgtaatcgggataagtggtcgacgcgccgatgccggtgatgaaggtgggcgagttggagaccacggcgccgtcccattcccggtcggtggacaggaaggggatcagcttgccgtccttctccttgatggcctggaccaccaccagcgggtcgacgcgggtgagcgtgccgccggtattggcatagcggtcgcaggcccccgaacgcccctcgcggatgcggcacagcaccgggcaggcgtcgcaattgatgatgccggcttcgacgacgtcgctcatgacggaactcccttggcggcacggatggcggcgcggacccggtccggggtggcggggacctggcggatggtgacgccggtggcgtggcggatggcgcccaggatggccggagcggtggggatcagggcctgctcgccgatgcccttggcgccgaagggtcccaggggctcggcatcctcgatgatgatggtctcgatgggcggaatgtcgcccgccgtcgggatcaggtagtcgtgcaggttctcggtgcggccctggatgtattcctccatcagggcaagccccaggccctgggcgatgccgccctcgatctggccttccagcagcatgggattgatggcgcggcccacgtcgtgggcggcgatgatcttcagcaccttgacggtgcccagcgcggtgtccacctccacctcggccatctgggcgccgaagccgtaggtggcgtagggaatgccctggccgttggcgtccagcttttcggtgggcgggtcgaaagtgccttcgccatccatgaccagcccatcctggtcgcgggccaggctttgcaggtcgatctggtgggtgtcggcgccgtcgctgacgcacaggatactcccgtccaggctcagcctggaatcggctccggcattgaccatgcgcaggatcttgtcgcgcaggtccagcccggccagctgcgacgcccggcccgacacgaaggtctggcgcgaggccgaggtcttgcccgcgtcggcggtcagcgccgtgtcgcccatcaccagggtgaacttgccgatctcgatgcccagcgcgtcggcgcagatctgggtgatgacggtgttggagccctggccgatgtccacggcgccctggaacagcaccaccgcgccgtcggcccgcagcgccacccggatggtggaggggttgctcatggaggtattgccgcagccgtaccacatgcctgccacgcccacgccgcgccgccggtcgccggcggtgcggttgaaggcctcggcggcggccagggcctcctgccagcggggaaccagggcgtcgaagcaggcctgctgcccgacgctggcggtgaggatctgtcccgtggcggtgggctggccggcggtgatggcgttgatgcgccggaactccagccggtccagtcccagcttgtcggccagctggtcgaacaggctttcctgggcgatggaggcctgggggatgccaaagccgcggaaggcgcccgacggcggattgttggtgtggatggcccgggtccgcgcccgcagggccgggatgaaataggggccggagcaatggaccggcacccggttggccacggtcggcccccaggaggcataggcgccggtgttgaagtcgccatcgaactccatggccgtcagcttgccgtccgcgccggcgcccacccgggcggtgatggcggccgggtggcgcttggtggacgaggccatggattcggtgcgggtgtaaagacagcgcaccggccgtcccaggctccaggcggccagggccacatagggctgcagcgacacgtccagcttgccgccgaagccgccgcccacggcggtggggatgatgcgcacctgctcggggggcagggccatgatggcggcgacgctgtccctgtccatgtagggcgcctgggtgcaggcgtagatctcgatggtgtcgccgacccggcgggcatagccggcctcgggctcgatataggcgtgctcgacgaagccggtggtgaagctgtcctccaccacctgggccgccttggcccagtgcagatccaggtcgcccttctgcacgaagccgcgcaccaggatgttgccggggcgcttggcatgcagcagcaccgcgtcggcggccgtggcctgctccatggacagggccggttccaggacctcccacagcacggggaagtcggcatcctggaagatgtcgttggtgtcggcctccatcaccacggcggccaccgcctcgccgcgatagcgcaccagcccctcggcgaaggcgggctggtcctccatgccgggaatgacgctgaacaggttgattccgggcacgtcggcggcggtcagcacctggacgatgccgggataggccacccgcagcgccgtcaggtcgccgatggtgaagcgggcatggggatggggcgagcggatcacccgcaccaacaggcaatcgggcgggcagacgtcgtcgccgtagatctcgctgccgtccaccctttgccgcccatccaggcggcgcaggcgggtgccgaccgaggacccggcctcgggcaccaccggctcgtcggcgaagcggtgggattccaccaccgcctggacgatcttgcggtagccggtacagcggcagagcacgccgccgatggcgtccagcacctcgtcctcggagggacgggggcgcgagcgcagcagcgcggtggcggcattcagcatgcccggcgtacagatgccgcactgggcggcgccgaaatgctcgaaggcgcgttgcagccgtcccagggcggcgccctccgacagcccctcgacggtaatgatttcccgaccggtcagtcgacccacgggaatcatgcaactgcacaccgattcgccgtcgatcagcacggtgcaggcgccgcaatcgccggcgtcgcagcccaccttggtgccgcgcaggcccaggtcttcgcgcaggaccttggagaggcggcgcatgggcggcacctccaggctgtggctggtcccgttgatggagagggtctggcgcttcatcagacaaggcctccgacttcggcaagcccgcgacggatcatggtcagcgccacgtcgaggcgatattccggcgtgccgcgcagatcccggatggggctgagcggcgacagatgggcgggggtgaccagatcggccaggccgggcgagacgggctggccccgcagatcggcctccagcgcctccaggcgcttggcgaccaccgaacaggcgcccaccgcgacggcggcccgggccaccttgcccgcgccatcggcctccagcagcaccgagaccatggcgatggaaatcaccaaagaggtgcgcgagcccagcttcaggaaggcggaggcggccttggcgccgccgtcgggaatcaggatggcggtgaccatctcgtcggggcggcgttcggtcttgcggttgcccaggatgaagcggtccagcggcaccttgcgggtgccctccgccgaagccagctccaccgaggcgtccaggcacagcagcggcggcacgccgtcggcggcgggcgaggcgttgcacagattgccgccgatggtgccgacattctggatctgaagggcgcccacctgccgcgccgcctgctgcaggccgcgaaagcgggcgggcaggtcggccgtggcgatatcgctccaggtagtcagcgcgccgaagcgccagccatcggccccggcggcgatgccccgggcctcggcgatggccgacaggtcgatgatcggccgggtgatcggggctaggccctgggcgggaaagaaatcggtgcagccggcgaccaggacgctgtcgggcgcggcggccaacagcgccagcgcctcgttcacggtggttggatagtcgcagcgcatggttctgccttccttcccgtggctcctacggcgggtctctgccgtattgttcgtacacatatgatgttaacgaaaaagggggcggcagtgtcaagggtggtgatcaggctttgggcaaaaaagtgaaaagccgtaaaattgtgcagcgcacaataatcaggtgaggcgcaaaagcagcttcagcagggtttcacgctcacgcgggctgaggggcgacagggtctcgcggctgaccgccagggccttttcggcatggccggcgaccgtctcgcggcccagctgggtcaggcaaagggtcaggcgccggcggtcgttgggatcgctggtccgggtcaccagatcgcgctccatcaggcgccgcaccacgccctgcatggtggcggcatccatggcggtcatccgccccaccagattctgagacagcgggccggtttcgtgcagcttggccagcaccgcccactgggtgggggtgaggtcggggaagtgctcctggaagatggcggtggtccgctggtgcgcccggcggatgacgaagccgatctgcccgtccagcgcatagtcaaggccttccgccgcgggttcatcgggctgggagtcgggcgcctcgggcttgttcatggccgcctcttgcatggatctcaaccgcctgtcgaatcggagagtgtttcatgtcagattatccgggcttggcaaggccgaaagtgtggataaccgcccggtgtcgtcgcgtcccatggcgtctctcggccattgacaagcggattatagcgcatgcacacttgttcgtacacaaacaacatgcgggaggcccccatgtccgccagattggtcattcgcaatatcggcctgctgctcagcggcgatcttcaccggccgatcctggacgccgattccgtgctggtcgaggacggacgcatcgccgccatgggcaaggccaaggatctggatgccgagggcgccaaggtggtggactgccagggcaccaccctggcgccgggcctgatcgacagccatgtccatccggtgttcggcgactggacgccgcggcagaaccagatcggctggatcgattccttcctgcacggcggcgtcaccaccatgatctcggcgggcgaggtgcatctgcccggccgccccaaggacatcgtcggggtcaaggccctggccatcaccgcccagcgcgccttcgccaatttccgccccggcggcgtcaaagtccacgccggtgcccccgtggtggaaaagggcatggtggaagaggatttcaaggaactggccgcggccggcgtcaccttgctgggcgaggtgggcttagggggcgtcaagggcgccgaggaggcccgccagatggtggcctgggcgcgtaaatacggcatccgcagcaccatccataccggcggcccctccatccccggttcgggtctgatcgatcaggacgtcatcctggaggccgatgccgacgtgatcggccatatcaacggcggccatacggcgctgcccgacaagcagatcgcctgtctgtgcgagacctgtcagcgggccatagagatcgtccacaacggcaaccagcgctcggccctggtggcgttgcgcgccgccaaggaactgaagcagctggagcgggtcatcctcggcaccgattcccccgccggctcgggggtgcagcccctgggcatcctgcgcatgatcgccatgctgtccagcctgggcgacgtggctcccgagacggccttctgcttcgccaccggcaatacggcgcgcatccatgatctggacgtgggtctgatggagatcggccgggccgccgatttcgtcatcatggacaaggcgcagcactcggccgggaccaacctgctggacagcgtgcgtctcggcgatctgccgggcgtcagcatgaccatcatcgacggcatcatccgcaccgagcgcagccgcaacacgccgcccgccaccaccgtgccggtgatcctctagacacaagggcgcatccatgaccggagccttgtcccatctgcgcattcttgacctcagccgggtgctggccggtccctgggcgggccagttgctggccgatatgggggccgaggtcctgaagatcgagaagccgggcgagggtgacgacacccgcgcctggggaccgcccttcctggacgcggacgagggacggggcgaaagtgcctattacctgtcggccaaccggggcaagcactcggtgaccatcgatttcacccagccccaaggccaagccctggtccgccgattggtcgcccaatgcgacgtggtgctggaaaacttcaaggtgggcggtctggccaagtacggcctggattacgactccctgaaggcgatcaagcccgatctggtctattgctccatcaccgggttcggccaggacggcccctatgcccagcgggcggggtacgacttcctggtccagggcatgggcgggctgatgagcctgaccggtacccccgatggcgagcccatgaaggtgggcgtggcgctcaccgacatcttcaccggcatgtatgccggcttcgccgtgctggccgccctggcccatcgcgaccgcaccggcgaaggccagcacatcgatctggcccttctcgacgtgcaggtggcggtgctggccaatcaggccaccaattacctggtgggcggcgttatccccaagcgtctgggcaattcccatcccaatatcgtgccctatcaggccttcgccaccgccgagggccacatcatcctggccatcggcaacgacgcccagttccgccgtttctgcgaggtggccgggcatcccgagctggggaccgatcccctttacgccaccaatgccgacagggtgcgccaccgcgccatcctggtgccggtgctggtcgagatcatgaccgagcacgacgccgattactggatcgccgaactggaaaaggcgggggtgccctgcggccccatcaacagcctggaccgggtcttcgccgatccccaggtgaagcatcgcggcatggcggtggccatggagcatccccagcgcgaagacctgcgcctggtggccaatcccatccatttgtccaagacgccggtgacctatgaccggccgccgccgctgctgggcgccgacaccgacgacgtcctcgcccgcctgctgggcctggacgagggcgagcgggccgaactccgttcttccggcgtgatctaggagtcatttgcatgcgcacccatctccacgtggatctgacgtcccgcaccatcaccaaggccgagatccgcggcgacgatctcgcccgggcgggccgctatctcatcgccaggaccctgctggagtccggggtggcccgggtcgatcccctggggccggacaatcccctgatcttctccgccggtccctatgccggcaccaacctgtccaacgccaaccgtctcagcgtcggctgcaagagccccctgaccggcggcatcaaggaggccaataccggcggtaccttcgccgtggccctggggcagcttgccctggcgggcctgaccctgcacggctgctgcgacgaatgggtggtgatccgcatcaccaaggagggcgacatcaccttcaccagtgccgaaccctatctgggcaagggcaccttcgaggtggccgccatgctgcacgaggcctacggcaagaaggtcagcatcgcccagtgcggtccggtgggcgagcgcctgggattgctaggcggcatctcgttcagcgaccgcgaaggccgtccggcccgtctggcggcgcgcggcggggtgggtgcggtgatgggctccaagaaggtcaaggccatcgtcgtcgaccttaccaagattcccgaactccacgaccgcgccaaggtcatggcgtccaccaaggactacgccgccaagctgtccgagcaggcgccggtcaaggccatgaaggaacgcggcaccgccatggtgggcgacttcaccaattatgtcggcggcatgccggtgcgcaatttcagcgccgggcaactggtcgaccccaaggtggagcccctgaaggtgggcggcgactatatccgtgagcgcaacatggggcggggcggcaatccctcccatgcctgcatgcccggctgcgtcatccagtgcagcaacgaatacgtggacgagaacggcaaggaactggtctcgcccctggaatacgagaccctgggcctgctcggcaccaattgcggcctggacgatcccgacgacatcgcccggctgaactacatctgcaacgacctgggcatcgacaccatcgagaccggggccaccatgggcgtgctgatggaggcgggccagggcgcctttggcgatgtgggcttcgtggctcaggccctggccgatatcggcgccggcaacgagcgcggccggctgctggcccagggcaccgcccgggtgggcgagcattacggcgtccggcgggtgccggtgatcaagaagcaggccatcagcgcctatgacccccgggtgatcgaggtcaccggcgtgtccatgatgaccaccgcccagggcgccgatcacaccaccggcaacctgcccatgatggacaccaaggacaaaagcgttgccgaggtggtcgaggccagcatcaccgcccagatcaacgccgccatcgccgattcgctgggcttgtgcgtgttcgggcgctcggtgaccgacaccaaccggcaattgctggccgaggcggtcaacgcctgtcacggcaccagtatcgatcccgaattcttcctggaaatcggccgcgagaccctgcgcctcgaacatcgcttcaaccaggaggccgggttcctcaccgccgatgacgaactgccccgcttcttcctggacgaagccctgccgcccaccaacaaggtggcgcgctttcacgccgaagaggtcgggcgccatatggcggggctgttcggatagctgcggccattcgggggcgtttgcccccggtcccccaatcgggaagcccagcttcccgagcccttcagtttcttaatcgattgaaatcaaaagaaacgggtccgggcggtagccccgtgcgtgcaagtcgtcttcacggcgcgatgacgaggccgcccttgccgtccaggtgacggtcaggcggggaggcagggggggctttacgcccacctgaagggcggtgacgtccggcgacaggtccaggcgcaccccggaatcccgcaaggcccccagcagggccgtccgggtcgcctcgccgggctgggccagatgggcggccagggtttcccgtatccggggcgtagtggcgatggcggcggtaatgggcttggctggcatcaccgtctcctgcaccgcattgaccagccctttgggcgcggcgggagaggggggggcgacgggttccaccaccgtcaccggcggcggctcggcgcggatcactagcagcccggccagggcggcggcggccagggcgccgctccacagccagaggcggcggggcggtgacgggcgggccttggccagggcggcctccaccaaggcggggggcgccttgggcggggcctgcgtcagctcgtccagccaggccggtccctggccgtcaaggcggtccagggcctgccgcgccagggcggcggcggcctggtccggcgtatcggagaacagggtgcggctgaggtcttggtcgcgcatgggcttgtccgacatcgtcatcccctggtcagacgggcggcagggggaatttctccaccccttccgcccttaattcatccagcagcaaggcttcccagcttttccgccgccgatacagctcgtccaccggcaggcccagccgtccggcgatgtggcggggcgccaggggaggcacctccaggaagcgaaggcgcagatactggcgggccaaagcgggaagccgggccatggccgccgccaaggcggtacaggcccgctccagctcctcccgttcctgcgccgtgctcagggcttcctcgggcgagggcgcccaatggggcagggggcgttcccactcccgcccgtcgccatccaccagggtcagcggcaccatgcgcggcgcgggctggaccagccgaggccccagggccgcctcggcccggtccagggcggccatggcctcggccgccggaagggacagcagatcgggcaactggtcggcgcgatagccctggatgtggaccagatgataggtgcggcgctccaactcgcccagcttgcggatggcgtcgggctcgcgccgccgcccgtcgcgggcgcgcaggatgtcttccatcaggttatgggcgacgcggcgcacatagccggtgaagctgccccgcccgtcatagcgccgcaccggggacccgccatcggccatcaggcgcaggcgcaactcctgcaagatatcctcggcatcctcgccttccagccggcggcggaccatgcggccgaggtcgtcggcgaagaagcgctcgaaggcagtccagccgcgccgggaatcctcggccagcagggtggtgatgcgctccgccagtccatcggcggccttcagccccagaaaggtggaaaagccggaccggccgtcccagtcggacagcatggccgcccgctcggcccccaggcgccggaccagggcgggaaattcccgggcgcactcggcctcgtcgaacaccttgcggcagcagccccacagcagatcggcccagcggcgggccagcgccgcccaggccgcgtcgtcgccggagcgcgctgcccgccacaattccagatcgcttcggctatccccgcccatggccctcgaaccgccccacacgccgtgccggggccatggtagccggaatcggcgcggcggaaaggtcaagaatggcagaaaaggcgaaaggcccccggtttcccggaggcctttcatggtgctgccgaatggaatcgaaccatcgaccttacccttaccaatgatggtccccggaacatatggtatgctgtttcgccaaaataaccaaatgttgcgccaatcgtaccaagacagccaatgcagttctctctattttcctccggaatggttcatctgaaccagggggaatatcctatatctcgagggcggcggcggcgtccttgaggtggtcaggggagaagcgggcatagaccctttcggtgatcttgtggtcgctgtgccccaggtattgggcgattttctccatcgaaacgccatcggccgccatccaaacggcggcggtatgacgtaggtcgtgcggcgtgacgtcatcgagcccggcattgcgggcggcggtggcgaatgccttcttgatgttcccgaccttggccccgccatattcgaccacatagccgctgtcctcgcggcgctggttctgcgcctgcaagacggtgcgcaggctcttggtcatggggaccacggcgcgggccttccctcccggcttatttcccaggaagatccggccggcggagaaatcgacctgtggccatgtcagttcgagaatggcttccttgcgcgccccggtggccagggccaagtggaggaaggtcaccaaatggggatgcggctgcgcggcgtcgagaagccgcatgaattctggcctggtcaaccaccgatcccgtggcggcggaggtgaggggagttcgaagaccgctccgccgccggcgtctcccttcgcccagcggatcgcggcggccagaaaggatatttccttgcggatggtcgccggcgcttttccgcgcttggaagcatattcccggcaccacccccgatcgatctggtcggggcggaggcctgcgcaatggggcttgaggacgccccacatccatcgcatgtattcagaggtgatggccttggtatcggccagataggcatcaacgatatcggctatggtgtctgacttcggctgagcgatcgccctttcgagatcagcgcacgcccgctgggcagcggggtaattatccggggtggcgtcgagatttccgagggaccggcggaatcgctttcccccgacatggacgacggcgcaccattttcctcggaaatcgacgatccgcactcgaattcctccacggcctggatcgtgatgcgaatgagctttcccagccgcatggcctggagctttttcgcgcggaccagattgtaaacatgctggtccgaacattgccacctttctgcgagctgggcgggcgtcagagcgcggggttgcatggtctttctctcttaatccgaggtctactgggccgaagcggccgttccgggcgctgtgacgagttggtctacggcctgttgatttccgatctggatgttcttggccacgacgtccatcgccatagcaggcgtcgtcactctctggtcttggagggccactagcttcccaaccatgttcgacgcgatggccagtatttcgagcggggaaagggccccggcgtgcttcgccaagattttgtttagatcctggtacgcaatctcgtgggcggcggtggcaattctgtttgcggtcatcagactatccttccaattgcatcggtctaaacgatgtcagtagggcagcggttcgtggtgcgggcacggggcagtctgtggatgcctatccaggcagacgtggccccgggcggtggaattgatgcagtcgtggcactgcggcggcagttctgccggcgggacggtgtcgtcgtgcggtgcggacgtggtcatggctcggtcctccgcgtggggatgcggcgggcgcccaccttggtcaggtcggcggccacccagtggcggcgccggagcgcgatccgggcgagcgcgatgatctggttgcggctgccgccgtggcggaacaggccgagatagctgttgcaggacggcatgaagtcctcggccgggatctccatcagccggcgcagggcggcgcggtgggttctggggcggccctggcggcggtgcgggcggatgacgtggccgacgaaatcgacgcccttggtgaccggcgccacgaaggtcttgtgctcggcaagcttcaggccgattccggacaggtggtcccggatggcctcggcggcggacagcagcgccttggactcggggtggatcagcaccatgtcgtcgacatagcggacgtagtggcgcatgccgaggcggcgcttgatcatctggtccaggccgtccaggtagacgttggcgaagaactggctgctcaggttgccgatgggcaagccgatgccgggcagtgcctggaacaggcttttgtgcggcggaaccagggccagggttccggcgccgtccttgacgatggcatcccggcgcacgtcctggaacaccagcttgcggcacaattccagcatggtggggtccttgatccggcgggccagcatggcgaacaggtcggcgtggcggatcgatccgaagaaattggcgatgtcggctttcagatagaaggccggcttgctccagttctcggtggccgagcgtaggtggcggtgcaggcgctcggcgccgtacagcgtgccgcgccccttgatgcaggcgcaggaatcggcgatgaacgccggctcgaacagcgggttgatggcgcggtagaccaggtggtggacgatgcggtcgcggaactgggcggcccacacctcgcgcggcctggggcgggtgatggcgaagacggtcgccggtcccggcatccaggtgcctgcctgcagctcggccagcaggtccatcaggttgttttccagcaccatctcgaagtccagggcggaagccgtgttgcgcttgtggcgccggcagtcgtaataggcctcgaaaagctgggacacggtgatgtctgacggctgttgcgtgatcatgtgcggacggctcggacccggtttctgttgttcttgttgttgttgttctggttgccgttgttgaagttctgcagccaggcgtagccggaccaagtcctgtcgggggtgtacaggccgggccggcgattgagtcccctcatcgacgccggccgagctgcgccgggacgcgcgggggagcacccgccgtatcccatcggcgcctggagcgaccccgtatgcatcgggaggggccgctaccccgaccaaatgatgcgcacgggcgcgaaggccttgaccttcgggcatcaggcgctcctcgcgtatttcagccatgccgtcgcctgcttgccgacgccggtggtcagttccaccgtgtccccgaattgcttgggggagatcaggtgaagatccttggacaggcgcaactgcaagcgcagcacctccaggtgttcgcgcatcctctcgatgtgcggcaccttggccgggccggtgacgcagttggcgcggaagatctccaccgccatctgctggctctcggtcaggatctcgcgggccagaacctgccggtagttgcggggatactgtcccgtcagcttcgccagaagctggaccagggcgtatgtctcgcggtagatgggcagttcagtggccagcgccatgcaaaacctcctccaggcatcacccggccgccgaagcggccggataaagggttaaagggctaaagaagacatttgcggacggctcggacccggtaactgaaactcttggcgctgccgtcctggtagccgtagtagaagtactgcagccaggcggagccggagctgtactgggtgctggtccagtaccattcctgccggaaggcttcggggctgccctcccggaatacctcggccaggctctgcgccggagtgatgccggcccggggcatggcggtggcgcggagcgcggtcatctggtccagcgccgggatgtgccagccgccgacgccgtcgatttcgaggtccaggatcgtctgggcgatctccgagccggcttccgccatcgcccgggtattggcgcggccgtcgagcagcgagcaggcgccgggcacgtcccggagcttcttcagccacggaacggggtcgaagtcgccaacctcagcacgcgacacgacgagaccggccagggcgccgttttcgtcgatataccgggctccgaggaatcccccttccatcggcgttccgatggcgggagtgatggcgggggtgatcaggctcattcggatctccatggtgcgtgtgggaaggcccggccgccggagcggccggtaaagggatcagggggtgaaggggaggcatttgcggacggctcggacccgggttctgaagtccttgccgtagaagtcctggtggccgtcgccgaagtcctgcagccaggcgtagccgggtctgtcctgggtgctggtccagtgccacgtcgcctcgaaggcctcggcgccgccctcctggaacgcctcgaccgccgtctgtgcgggattgccgccggacagcggcatcaggttgcgcatcagggtctgcatgtcgtccaggctgcccaggtgccagtcgtcaaagccgccgatgcgcagggcggcgcagaaggcggcggccgggtgatcggcgtcggcgatgtcgcgggtattggcgaggccgtcgacgaacgacatcgccccggggctggcggtcatggtggtcttccaggccaggacggattcgccctcggccttgggcgacacgatgatccacgtgccgtcgcgggacacgccgccgaagaacccgccggccatgggggtgccgagggcgggaacggggatgatgctcccggaaatgggcgcggtatcggcgttgaggttagtcttaatcacggacatcgtctcctattcggccgcgtcgcgaatggcattcgcgggttcggcgggttgggggcgcgggatcgggcggactgcgtcgatcgtcgcgtcggggaaatgggcgagcaccgcccggacgagagggtggtcgcgggcgtcggacggggcggcgatctcgtcgcggcgagcgatccaggcggcgcggagcgggtccacgaggctgggggcgtgcgctttcaggcgatcgagatcggcgcgggcgcggtcggcggcgcggttgagatccgcgagggtgccggcggcggcgaagctggcctcgatccgctccgccagttcggcccaagtggcgcgcgccccgtccattgccgtcacccccggacgcggtagcggctgcgccggccgagcagcagatcggcggcgtcggcggcggtggcgaaggggatctcgtcgtcgagatcggcgggaggctcccatgatccgccgccgccggccatgctggacgtgctgcgcccgttgggggcgacgccgccatcataggggcggtcgcgggtggtgccgtagccctcgcgctcgtcggcggggccgcgattgccgccgccgctcgacggcaagagggtgaggtcgcccttgaagcggccgatcaccacctcggtcgaatagcgctcgacaccttgttgatcggtccatttgcgggtctggatctggccttccacatagaccggcgagcctttcttcaagaaccgctcggccacctcggcgaggttggggttgaagatcaccacccgatgccactcggtcttttccttgcgctcgccggtgccgcgatccttccatgtctcggaggtggcgatgttgagattgacgatcttcgatccgtcctgtccggtgcggacctccggatcacggccgagatgcccgaccaagatggccttgttgacgcttccagccattatttccccctcttggcgtggcaatgggcgggtgtccgggcgatgccggcgagcttgaggtgtttcaggacggtggtccgcgcgacgccgagcccggcggcgatcttgcgggtcgtcgggtccggaacggcgcgccaggcggcggcgatccgggcggtcaaggcggggtcgggcgagttgccccggcggacgtccagaccggccttgcgggcgcgcgacaggtaggaccggaccgaatcctcgtcgatccccatggcggcggcgatctccggccgcgtccgtcccgtgatggccaatcgggcggcgcggacgatgcggggctcgatggcggcgggcttggggccggggcggtgcgctttttgcggcggccgcgtcacggggcgaggtccggcggtgcggggcggagagggaggcggcgcgcaagccgtcgccggcgggatggcggcgatcgcctcggcgccgagggggcgcgtgcggcggccccggtgccggagattgtccggaagaggggcaaagccggacgcgggttgaatgacctgaatgcggccgcccccggcaaggaaacgggcgatatggtcgtcgagggtcatggcgccgaggttcatgccaagcctccctcgagctcggcggcgaccggggcgaacttggcgcgcacggcggaggcggaggcgccggtcacctcgaggcggcggcattgctctcccggcgacaggtggcggacttcggcggcggtttcggcgcaggcgcgggcgagccgggccgaggcctcgtcgatcgccacggggtcgaggccgatcacctcgacccggacgccgccgcccagcgcggtggcgcggaaggtgacgacgattccacgatagcggaacagatgatccgttgcggcggcggcgggacggcgcgtgctcatgcggcttctcccgtggccagcgcggcgcggtggttttccagcaccagcgcgaggtggtcgaggtcctcgatggtcaacaggacgtcgggggtgatcgacgggaggccaaaggcccgcgccagggtgccggcggccgcctcgatccgcgcctcaggcacgagctcgaacaggggcgtttcgccggtgggcgcaaagggattgtcgatgaccggcgccagggcggcgacgatggtttcgagggagatgtcacggacccccttggcggcgatcgcctcctcgaggtcgatctggcgggggtcgggaccggcgggcggggtcgccttcaatgccgcctcgatctcggccttgaggccgaagcgcagggagggcaggacataggtgggcggggcttggcagacgatatcctcgcgcaggcccttgataccgccgacgtcgggggcgtccgagttgggcgatacctgcgcccacacgtcgaggagggcgggcttgcggagcccgtcgagatcctcggggagcagggtcaggccgtgggcctcctcggcgccgatcaggccgagggagcgcgccatccccaccacggcggggcggtcgcccgcctcggggctgtaggtggcgaaggagccgacgcgcagggccaccagggcggcgaagaactcgcccacctcggcgtcggtcatggcggccagcgcgccccaggccgcgccgttgtccgcctcgccccaatccttgcggcgcacgtcgccggcggcgatctcgaagcccttcttggcggcatcggcgaaacgggggaggtagtgggcgatggtgtcctcgacatcctgcgaccacgccttgtcgtcggcgcccagatgctcggtgcggatgcggacgttctcgccgcagccgatcagggcgaggcaggcggcgcgcatggccatgacgggggagcgggacagggcggtttgcagggcgacggtcttgcgccgccgggcatggcaataatgccccttggtgacggacgaggattgctcggccggggcgtccccggtcaggcctgccgcgctggcggcctgcttggtccgctcggccttggagacgaggtcggtatgcacgaccaccaggccgttgcccttgatctcatagaccacgccgcgcgccgggtccttcttgtccgtctcccaatcccacgaggagaagtactcgccgggcttgcggccgtcgatgaccctggtccaggcgtagcccttggcccgggccttgatctcggcctcggcgatggccttttgctgcagcttctcgaatagcttggcatcggcgaaataggcgacgttcgggtcggattcgtcggcgatgagctcgccggtgtactccgccggcggaaagaaggcgaccgtggtcgggatgagcgactgcgtgaggtagcgcttgaggtcgcgggtggtggggaagcttcccttggctatctggtcgagcgccagggactgcgacggtagggggcagaaggcggcgaggatgttcgccgcctcgacggtgatccgtccgtcgcgcagggcatccttggcggcgacgtcgagatcgcggacaaggcgaaggcgcatttccaccgtgcgcttgaccatgcccacggtggcggcgatctcggcggccgagcggccgagcttgcgcagcttttcgaaggcctcggcctcttcccacggggtcatatccttgcgggcgacgttttccgtcaatgcgagctcgaggagcttggcgtcgtcgcagggatcgatcagacggatcggaagcggagtatcggcggggcgttcgcccgcatcgatcaggcggcgggtcgcctgccaacggcgctcgccggcgatgatctcgtattcgacccgggggtcggtgggctgggtgaaggcctggcgcgcgtagcggacgaggagagggaggagcacgccctcgatccggacggaatccaccagcttggtgagctcgtcctcgtcgatccgctggcgcgggttgaggggagacggcgcgatccggtcatggggcgcggcagacacgcccatgggcacgacggcgggggcctgcgcgggcagtgacggcccggccttggcggcgatcgccgcctcggcgcgggcataggcccgcacagcggcgctcttgtccacgccgaagcgcgtgccgatttcggcgaaggacggggcgggggtggcctggcgaagatcgtagatttcgcgttcctgctcaggcgtgagcttttgcttgcccatggggatggtctttcagttctgggggtggcggggcgcggacaggccgcgcacggattggatgacgacgggcgaccccggcgggcggaagaagcggcgcaggcggcggagaagggccccgatcatgattgcgccccctcggcccgctggcggcgctgggcggcgaggtcaagacgcaggcgctcgcggcgcaggtcgcggagctcgtcggcgacttcatcgcggcgggcgcgccggcggcgctgggcgtcgcgctgttcgctcaggtcggtgaccgattccgcgcgggcggcgcgggcggcggcagtgtcggccgcgccggcggcgtcattggcgaggaggcgccgcagcgtgtcggcggtttcggcctcgcggtcggtggcggcgaggaggacgcggccgccgatctcgatcagggcgtccaattcctcggcctcgcgctcggcctgatcgatgcgccgccccagactggcgcggcgggcggcgatcatgtcgtcggtcaacaggtagagacgcccggtggtcgcctccatgtcgatcacccggcgggtcatcagggcgaacagagagtcgtggcggtccaactgccaggcgcgaacgtcctcgcccgaggagaggcgggcgagcagggcgtattgcggctgggtgaacttctcgccggggaaggcggcggtcagggaggtggcggcgagggtggcgcgaatggcattcgcagggcagggcgatgatttggaagcgatcatgtgccgacctttcgatcttgccccggctggggcattccgggcgggacctccgcctgacgatcggcaatattaggcatggccttatttttaggtcaataatgaaattagggctccccgtattttgttggcgatgcatgcacagagttctgtgttgatgccctgatccggcggtgcggcagaatgcccggcatggcgaagagggttcccaaactgtcgcatgaggcggcaccgctggcccggtccgtccacgccttcatggcggggcggggcctgtccatgcgcggctggtgccggcgggcgggcctgtcggccaatgtccttgccgagctgttctcgggccggacgcgcagcctgaaatacgccaccctggaacgcctggcggcggcggagggggtcgcggcatccgacctggcggcgggtgccggactggtgcgggtgtccgacgtggcggcggcggtgtcagcctgggcggcggaacgggggatcgccgatcccgagggcgtcgcagaagaggtgatcaggcgactgaccctcgtccccgacgacgcatggccggcggcatagaccatcgaatcatgccattaggcatagtgtatgcattcggtgaaagtaatgggttgcgccgattgcaatctttggttctaaattgtcaggctcccgtcaggaaaggcgggggcttggggcgatgtttccaccccttgccgagcggagcgttggtcgcgcccgccaagacgttaattgtcttcccgccgtccggccggacagggggaagcctatggcttggggtggagacgtggcaacaggcaaagaggggcgcgccctcataaaggcagtggcggaatccttccgccacgcgaggccgatcctgttcggcgacgggccgggcaggcaccggtccgagtgcggtcaatgcgtggaccgattgcagcggcggcgcgaaaacgggcggcgggatgccgcctcagtccttggcgaattgcagagcgtggcgcaggaagttggctgcgtcagcgatgccgggcaatgtcccgtcctggcggcgcatggacaccacccaatcatgggtgcgcaggaccatggcggcgacgtcgtcggccgccggcagcttaagcgagtctgagatcagttcggtcacggcggcggcggcgacggcgacggcgtcgcggtccatgggcaccgcctgcgccagggccgagggaagctgatcgcttccccggccaagcaaccagtccacggacacgccgagcagatcggcgatggtcatcaggttgtccaggctgggcgcgctttccttcttccatccggagacgctggcgggggtgatgccgatctccttggacagcccctgccgccgcatcttcctctccgccagggcgagatcgaggcgccggttgaactcatccacccaggagggccggatcttcgccttcctggagatggcttcggttttgggcgagcggttcatggcgtgattgtgccctgacaagattttacggtcatctcagatgcgcccgaatctttcgcttgatctaagatttgggcgtgcctaatattctcggcatgaaaaagccgcgcacctacaagcatgccgatgccgccctgaccgaagcattcaaccggtccggcggattgtgcgcgctggccgaaaagctggagcgtactccggcttcgctgtccgggtggcggcgggtgccgccagagcatgtcctgaccatcgagcggatctcgggcgtgccgcgccatgtgcagcggccggacctgtatccgccgcccgaggaggtggcgtgatgagtggccgcccttcccattccgtccataggaggtcccatgcggatgatgctgattcgtgcggcggcgcgcttgctgcggccggtagtcgaggagatcgagcggcggcggggcggaagctcccctgccgagatcagggtcaagctgaccatagagggtgcggaggacgtccgcgccaagctggaagcccttggcgcggaagcggcccggcaaggcgggtgactcgtcaggcggaaacctgcgacgcagttatttccatcgcctggatcgccttcgcagcgtcggcgcccatgctttcgggaatgaccgatctggcgaggatgaaaaccatttttgcctcgtcctccgtcaacacccctttggctctcaggacgccgaccgcgatcccaacggtcgcggcgatggcgttgacgtgcgcaacaagcgcgttcggctcggacatgataccccctgctggctggtccgtggaaagtcaccagcataacgggtgccggagccggcgtcatgccggttccggtgagggggtgtgaatgatcgccatccctgcccgcctcaaccgtgaccgccgcaatgtcgccctggcggcgcggatgatcgtttccgtctatcgctgccttccgccgatcctgtgggattggtccgagcgggccgaccgcctcaagcgccgcgccgaaatggtcggtgacgccgccgccatggcgcgcgccgggggcttccggctgtggggctggcacgcgccgcgaacggtcagggcgcttttccgcgatcccgagcggagggtcttccgacatgacgactgagccatttatgggcctcgccgaaaccgtccgtcgcccattgtccggggctggccagttccatggtgacgaattgcccacgctcgccgatagcgtcgcggatgaggtggtccgggaccatggcctcggcgaggtagccgatcgcctgacccttgtcccaggcgaacaggatgcgcggctcgggcaagagccggccaagggcgaggcgctcggcctggcgggattcgagcctgccgtcgaaatcgacgagcaacaggaacgggcggggcatgacgtctccatggggttcgcttcggccgggttgatcatgcccgccaccatgcgccagggggagggggtaaatccatgacctcggcgagtgtcagacattccccgtccgccctgcacccggtggatctcttcggcgcctcggcgtcgggcctgcatccggtcggcgagcgcatcgccctttggctggcggacatccccgcgaaggtcgtcgcccgcgacttcgcggtcgccgtccatacggccaaggggtggaagcgcgggcatctgccgctcatggcgcatttcgcggccatggtgacgcggtggggcgacgacttcctcgatttcgcgttcgcgccggcgctggccgaggcccccagcctttcgcagcaattggaccggatggaaaagcgggcggcgcagttctcgcgcgatctggccgagctcaagcaacaggtgacccatgagaaggttgaggatcagtctcgccgcgctgctggtgcgggcggcgatgacgctggaagcgtggcgggaccgggtcgcgcgcgcggccgcatggtgtctcgggcgataggactcggccttctgctggccctggcggcgccgatcctgtccgacgcggtcgcgccggcggtctatgcctcggtcctcgacctgggagatcagggcgacgaccccgccgcccggctgcacaaggtcgcgcggcggcccttgcgcctgggcggcaagcgcgagttgtcggcatgaagaccgacccccttctcgacatggtcgaaagcgcctcggcggcgctgcggcactggcgggcgggcgaggcggccttcgccctgatcgaggcgcgcaacagcgggatcgccgccgcccgcgcccacgccgaaaactcggacgccatcgaaccgccggaggaaatcatcgccgaagccggccttgctccagcgcctgccccaccgcgggtgtgccaccggctcgggggcgatggcccggcaatccgtcgccgtctcgccggatctcggcggatatcgcccccgcgccggcggaaaccgggtggcgcgggccttgggaggggacggggaatgagcatcgtcatcgagtgcaagcgacatggagtggtggtaagccacaccaaccagccgatttgccccatatgcgaggcgtcgcctgcgcccggagcatgccagctttgcggtgagcctctgcgcgggctgttccgcaagcggtgccgcaatccgcattgcatcagcgccgttcctcccggccctcgccctcccgtggggcatcttatcgcggcgctcgatcatgtcggatctcgtctccggcgggatgcgaatgccattcgccttgatccgccatccgtcaccttcgtcaccgataatccgggcgcgccgatccgtctggcctggaccgattccgaggggcggttcttcacccgcgacctcgagacgcagcacgcgatcaatctgatcgaggatctggcgcgggcgctgcgctcgaggatcgggggcgcggaatgagcaaaggattgcagcccttcggcggcgggcgggtggaacggcgagccgccgatctctaccccacccatccggcgggaagcgtggcgttcatgcgggccgagggcgagatcctgcgcacgcgatttcccgtgctgtgggagcccgcgtgcggtcccggcttcatggcgaaggtgctggcgctgcacgggttcgaggtggtcgcctcggacgccttcgatcacgggttcggcgcggcgggcgtggatttcctggccaccacggaggcggaagcgccggcgctggtgaccaatccgccttatgacgacctggcggaggccttcatccggcatgcggtgatgacgctgcggcttccctatgtggcgatgctgctgaaatcctcgtactggcattgcgggcggggggtgacgctctggccgtccgtcacgccttcggtgatctatccgctggggttccgtctgcactggacggatggcggcgcgccgccggaaacccattcgtggatggtgtgggacgtggagcggccgccgatcgacggcgtcacggcgcgtctcatgcccgcgctgcccaagcccgcgtcatggcccgatctggggtttgacgactatgtgaggaggatcgcggcatgagccggagcgcggacatcgtggccgggctggcgctggagcttttgcagggcgcgaccggaacgctcgacgccttctcgcgccgcccacggcccatggtgacgtcccaggcctatgacctggcgcgggcgcgggtggtggaaatgaccttcgccggcgatgcggcgggactggcggcggcgatccgcaatgccgaacgggtggtcgccgtagtcgaggagctcggccggcgggtgcccgatctgatcccgggcggtgtcgaggccaatcgagccgccagctatgtgggggaggggtgatgcccagaatgcgccacgcccgccttctccgccttcctcttcaactggaaatcagccggttgggagtgaagcggaagaaattctatcgggaaaaatggctgcgcctatgggatcgcctttattggacaagggcatatgtcccgctgttccagcgcgaccttcccgtccaggcccaagtcatgcgccggttccggtgggcgatggcgcggcgtgaccggatggaagcgctcggccttgcaaataccattcgcggcgaggcggcggaatgatccccaagggctttctcgacgagatccgcgaccgggtgccggtgtcggccgtggtgggccgccgtgtcgccctggccaagaaggggcgggagtttacggggctgtgcccgttccacaacgagaagacgcccagcttcaccgtcaacgacgacaagggctttttcaaatgcttcgggtgcggggcgcatggcaacgcgatcggctttctcgagcgcgcccatggtctgagcttcgtggaggcggtggaggagctggcggccgaggcggggctcgaggtgccgaaggccagtcccgaggaacggcgggacgcggcggcacgggcaagcctgtatgaggccaatgaggcggcgtgcgcctggttcgagcatcagcttaccaccaccaaggccggggccgacgccctgttctacctgtcgcggcgcggcgttgctcctgagacgcgggcgcggttccgcctggggtgggcgcccaatggcgatgcgctgcgccgcgccttggatgccgagcgcttccccgacgatctgctgatcgaggcgggattgctgcggcggcgggacgacggcacgaccggggcctttttccggggccgggtgatgtttccgatcatggaccggcgcggtcgggtgatcggcttcggggcgcggaccctgtcggccgatcctggggttccgaaatacctcaactcgccggatacgccgctctttcgcaagggcgaggtgctgtatgggctgtcgcatgcccgcgacggcgcggccgagcattcccgcgcggtggtggtggaggggtatctcgacgtcatcgccatgcatcaaggggggttcccctatgccgtggcgccgctgggaacagccttgacgccgggtcaggtggaggagatttggcgcctgaccccggacgggcggggcgaggggccgatcctgatgctggacggcgaccgggccggcgcggcggccatgcggcgcgccgccgaggttgcggtcccgatcctcaggcccggccgctcgctgcgcttcgcccagatgcccgagggcgccaaggacccggacgagcttctcaatccgcccggcgattccgtggggccgcaggaaggggcgttccgtctggcgtcggcgctgggggcggcgcggccgctggcggatgtgctgtgggaggcgttggtcgccgagatcccgccggatacgcccgagcgcttcgccgccctggaagcgcgggcctatgggctggcggtgcggatcaatgaccatgcggtgcggcgcgcctatctcgccgactggcggcgcaggctgggcgaggccgaggacatggacccgcctgttttgcgcctgggatcggccaagacccgcttcgcccccgccaaagcccatctgcatctcggccttgagtggcgccgcgcgctgcgcgatgccaagggcgacaagggcgaggcctcgccggtcaaggcgtggctcgaggagcggggcatatcctgggagggcgtggcgcgggccttgggcggcttaggcgtggtgcgcgcccgggtggtcaagggccgatgggaccgccagtggagcgcggtcgaaccggcgagcctgtgggagccgtgggccgaggccggcgcgccggtcaagctgatccttatccctgaatgggagggcggtccgggcggacggctggtggatctgatcggctggaacccgaaaaccgacgaatgccattcgcgcacgggacgcaccgtgacccttctcgaggatgccgtcgccgaggccatggggctggaggcgcagggactgccgagcccggtggcgatcgccgcctcgccgctgtcgtggttgcggcggatggcgaaggcggccgaggccgaggccaaggcccgccgggacaaggccccaccgcccgaggccgaccgctgcgtctatgtggtcgattgggcgcgggcctgggacgtcttgggcgggttgcgccaggtggtcgccgagagcgaggcccattgggatctggtgaacaaactgcttcgtccgccccggtggcggcgaccggatatcggctatgtggtggaggggtgatgaataaggttgtcgcatttcccggcaagggtgaagcgcggtccaagaaggaaaagcgcggcgggggcggaggaggcggcgcgccgcccggggagcgcgatgcgctcgaggcaaaggtcgcggagatcaacacgtcgcatgcctttgtgctccagggcggccgctccttcgtcctgcgcgagcttatccaccccacgttgcatcagccgacgcaagagtttctgaccacaaccgccttcaaggatcttttcgggatcgatcggttttacgacgccgagcaagaccgctataccggcctggggcatttgtggctcaagcacaaggcccggcgcgggtatttcggcgtcaccttcaaccccgagggcgccccggacgggtggtataacctgtggcgcgggttcaccatcgagcccgctccggcgacggaggactatcgccaccactgccgccagttccccaccttgaccgaccatgtgttgagcaatgtggcgggaggggacaaggcgctcgccaagtggatatgggcatggttcgcccacatgatccaacgacccatcgagcggatcggcgtcgccctggtgctgcgcggtcggcaggggtcgggcaaatccgcactcggcgacgccgtgggcatgctgctcggcccacactacacactgatcgatgatccgcgccatcttgtgggaaacttcaacgcgcatttggcgtcgtgcctatttctccaggccgatgaggcggtatgggccggcgacaagggggcggccgggcgcctgcgcagcctgatcacgtcatcgcggaccctgcaagagcgcaagaacatcgatgcggaacaggtccgtaatctggtccggctgctgatgacgtccgaagaggattgggtggttccggcctccaaggaggagcgccgcttcgccgtgatcgatatcggcacggggcgcatgcaggatcgcgcctattttacggcactgttctccgaactgaagaacggggggcttccccatcttctgcggttcttgatggacttccccttggaagaggtcagccttaaccagctccccaggaccgaggcgctgttcgagcagaaggccgccaacttcgataccgaaaccgagtggtggtacaactgcctgcagcaaggggccattctgtctgggcacaggaaatgggcgcatgaggtgccctcggccgggctctatgccagttacctttcatttgctgaacggaccaaggcgcggcgcccgttttccaatgctcgcctcgggatcaagctgcggcaactgatccctctcgagtatggtttcaagccgggcaagatcaaggttgaggtggacgacgtcctccctgatggctcccgcattccgggccgaaatggagacggtactccgaaaacggagtgggtcaacggctaccagatgccggggctgaccgcttgccgccagcatttttgcgcgatggtgcgtcacgacatcaaatggccggacgatgatgtttcgggcgcgcccgactgcgaaaaggcggatagcgacgctccgttctaggtcgcgcccttgataggctttccaggcaaggacgatcagcctggaaagagaagcaatagataattcagtcgctttccaggcattccaggctttccgggcatttttgtcgatacattccatacgcgcatatgacgcgctacacacgtaacttactaaacacttattagcatggaatgcctggagtgcctggaaaaagaagatttgtcagatggttgcgctttccagggaagcatggtctgccctgaaagcctggaaaatggaggaattcatgggggctgatagggtgatcgaaatcgacggaaggcatgcggtaaccgtcgagcttgacgagggcgcagtcctggcgaaggcgctccgcgatgtggcggcgcagatcaaggacgcgatgcggacaatccgccggatgcccctgccgcgagaggtatccggcatggccgagaccacggcgtcgatctacgccgcgatggctcagacggacgagggggaaagccggcggcggcggccgccttcgtcggccgctatcgatcgctgcgacacgatgttcgaatacctgatcaaggtcgatgatgaggcggcgcggaacctgctcatggttcgggggatcggcctgacgtgggagcgggtgatcgcggagctcgatcttgggtgctcgatcagcaccgtcaagcggtggcatgaggatgccttggtcaagatgttgtgcctcatgctcgatcgggacacaaaaaaggcttgacccgattgggccgttttgtggtagatgttgcgtcatgctgtgactgttgcgcccgccctgggaaccccgaggcgggcgccgccattctgggcggtcgcaatgcgggggacaccccccccaccccggtggggcggggggaggggaggggtagcaatcgccgggtcgatgccgggccgaagcccccaccccccctttttcgggtccttccattttgccaaacgctatacgggccgcaggggccccgggtttttctagtgttgccgccctgaaattgatgcaacgggccgaccgagcaacgggcaacaccccccctgcaacaggacgtcattcccacgcaacgcgaaggtgccgctatgagcgaaggccagcgaatgggcgtgcgccaggcggcgaaaaagctcggcctcaacgcgagcacgatctcgcgctatcagggcgagccgaattctctgatcgacaagcgcgacctgtcctatcgccgatcgggatacaagcggctttacaattcgaccccggacaagacggtcaaggatcgcgacgggaaggaggtcgggtgccggaccgaggccaagtgggatgagtcggatcagaggcggcgatacatccgctgccctcattgcggcgcctatcaggtgctgcgctgggataatttccggttcaacgaggtcgagccccatggcgcatatttcctgtgcgccgatccgacatgcggcggagtgatcgacgaggggtatcacgacgagatcctcgccggggcgatgaccgagcggacgatccaggccatgggcgaccgggccgaggagatcctcgccgatctgatcgccggcaacgagctcggcgccgtgtggatcaagacctatcccggagacgattgccccgggccggtgatccagcccgaggatctgccgcgcgcgctccttcgtccgcgtcggggtcgtgtggtcgggttcgccggatggaccgccatctccatgaccgtcccgttcgacgacatggcccatgagtgggtgacgtcgcggggcaagcccgagaaggtaaaggacttcgtccgccaggtgctgggcgagccgttccagcttcgggtcaacgtgcccgaggcggagaagctcctcgcccgtcgccagtcctatcggatcggcggcgtgctgcccaagggcgtcctgttcctgaccatgacgatcgacgtccagggcaaccgcctggaatgggcggtttatggctgggggatcggcctgtcgtcctggctggtggacaaggggatcatcgagggcgacacgggcgacgatatcgtctgggcgcgcctcgacggcgtaatcggccgccgctaccgcgacgccgccggccgctcttggccggtggatgcggtcggggtcgatacggggttccggacccagcgggtttaccgctgggtgatggctcacgccacgaccggccgggtgttcgccctcgacggtcgtgatggatggatgcttcccgccctggggaccccgtcgaaaaaggacgtcgatttcaacggcgccaagatcggcgaggtccagctttggccggtggggacctgggacctcaaggccgatcattacgccgcgctggccaagttcgccaacggtccggacgcggcgggcaagtgggcggatggcgtggtcatctatcccgacgcctgcgaccgggagtatttcgagcaactcaccgccgagtaccttcgcgaggatttcgaccagtggggtcgcccggtgtcgtcctggcatcgccgctccaagggcaagcccaacgaaggcctcgacctggcggtctacggccgcgccctggcgcaccacctctcggacagcctgacggcggaccagtggaaagcgcttgccactgcccgtgccgccgatcccaaggccgcccagaccgatatcgaggaatatgcccgtcgcctcgccgaggcccgggccgaggcctcgggcgagggggtgtcggaggaggcctcggccttcatcgagggggaaggcgggcgcccgcctgcgaatgccattcgcagccacgacggcggcgggttcatcgatcgggatacgaaaatatacgaccgcttttgaaaggtgccgccatggccatcacccaagccgatatcgaccgcctcgacaaggcgatcgtctcgggaaaactcacggtcgaggtggatgggtctcgcgtcacctatcgcagcatggccgagctcatggtcgcgcgtgaccatgcggtcaagctggtaggcggcggaagtgccgcgtccgggagtggactgtccgtcgtatcgttcgagaggtcatgaccatggcgaacccgttcgacaggatgatcgaggcggttgcccctgtctggggtatccgccgggcggcggcccgcttcgctctcgaccagtatcgttcctatgccgccgccaagtcgtcgcggcggaacgactgggcggcccccgccacctcggcgaatgccgagatcggcccccaggtcgcccgtatccgtgcaaaggcccgcgacctggcgcgcaataccgagctcggcgccaatgccgtacggcgcttgtcggcgcatatggtcgggaccgggatcgtcccccgcctggcgagcgaagatgcggccgagcggcgggcctttaccgagcggtttcgggccttctcggatcattgcgatcccgaggacatgaccgattttgggggcaagcaactcgaggtcgctcaatgcgtggtggaatcgggcacggcgctcatgcggttcctgccccgtccgagcggatggcgaatgcgggtcccgctgcaagttcaagtgctcgagcccgattacatcgatatgagcaagaacgagatcggcaacgatggatcgatcattatccagggggccgagtatgattcctgggggcggcgggttgcaacctggctgttcgaggagcatccgggcgatgtttggcccttgggggcgggcaggctgaaaagccgccgctttaccatggatgaggtccgcccggtcttccatcgtctccgtccgggtcaggtgtggggtgtgccgtggttcttccccgtggtgacccgcatgcgcgacctcgccgattatgaggaggccgagcatctccgcaagctgaccgaggcatgcttcgccgtcttcatcaagcggccgccgggctcggcgcaaagtccgctaatcccgggcgacggcaagaaggacgcggccgggcggtcgatcaccaagatcacccccggcatgatcaaggagctcggcgtcggcgaggaggtgacgttctcgcagcccgaacccgtcgccggggcggttgacgtgctcaagcatcacatgggcgttgtcgcggttggcctcggcctgccccggcacgaactgacgggagacccccgccgcccccgccgcgccctcggcccccgccgcccccggcttggacgaggctgcaaagcaaggggccaaaccagctttcggacggcgatgatgggtggctcgggccgttcgtggcctgcgatccggcgaccaaggcgaccgcgatcggggtcgataccgtctttcagcgcggactctattacgccaacaacgacgggtcgcttgcgacgcgctcggtggattgggtggtcgaggtccgcgcgatcgacgacagcggcgaacccctcgccccggcgcatctggcgggctatccgcaatccaaggcgaccgggcgtctgctgttcaccgtcaacccgaccgccggcgataccgcgaccatcaacggtgtcgtctggacctttgtcgccggcgcggccggcgcggctcaggttaccatcggcgcggatgcggcggcgacggtaaccgcgttcgcgggtgccctcaacgtctcgaccgatccggcgttgaccgtggccacctatgcggcggtcggcaaggggctggtggtcgaatacgatacggcgggcctggccggcgagtccttcacgttgggcgcgagccgggcggtcgcctcgggcgagacgttggcggggggcggattcgcccggatcgccagcgaaagccactcggcggcgacgaatacggcgatccgcctgtcgcacaaatacacgctcgcggccgagcgctatgaggtgaggatcaagcggaccagcgacaacacccaagacagccggaccgggcacgagtcccggtggtcgcagttgcgggccgtgctggacgaagaccccaattacggcgacgtgaccttggtcgccgtcaagatgcgggcgaccgacaacctgagccagcgttcttctcgcctgatcaatggcgtggtggtccgcaagctggcgacctacgatctcgttacgggcgagtggtcggatttggcggcgacccgctcgatcgcggcggcggcgagttacattctccgcgccgaaaacggggcgagcctggccgatggtcacaacgatctggcggcgctgtggtcgctgcatgcgacctgggatgcgcggggagacaccttcaacggcgttttcgacagttcgctcaccgcctgggacgcagtcaagcgcgtcctcaacgtggggcgcggcgctccctttcaacagggcggctttgtccgttacatgcgggacgagccccaggaaatcccggcggcgctgttcaatcgccgctgcatcgtccgggggtcgttctcgatcgagtacgacatgccgagcgacaacaccgccgacgcggtgaccgtcgagtatttcagcgaggcgacgtggaagatcgccgaggtgaccgtcgccatgcgcgatggatcgatccgcgaactgaccccgaccgagttgcgggacagtcccccggccaagccggcgcggatgcaatatttcggcattaccgacaaggcgcaggcggagcgcgaggcgtgcttcgtctgcgcctgcaacatctatcgccggcgtcggccgacctggcggaccgagctcgacgcgatggtcctgtcctatggcgacgtggtggcgatctcgcaccccctgccatcctgggggcaggacggcgagatcgaggcggtcgagggggcgtgggacgaggtcggggcggtcctgaccctgaccgagccggtgcgatggggagatgcctcgactctgtttctcgccctgcgccggcgggacgggcggctcgcctcgccggcggtggaagtcgaggcggcgccgggcggcgacccgaataaggtcgtttctctcgatcctctgccgatcgagcccgatacgggcggcgatcgcgagcgcacctat

(The sequence listing continues in the following parts.)

We claim:

1. A method for modifying a cell to express a magnetosome-like structure where previous to said modification the cell does not express a magnetosome-like structure, the method comprising:
   transfecting the cell with a construct comprising one or more magnetosome genes under the control of a promoter, said one or more magnetosome genes encoding at least one magnetosome transmembrane protein; and
   subjecting the cell to an environment containing iron;
   wherein the cell is selected from embryonic stem cells, islet cells, neuroblastoma cells, bone marrow stromal cells, breast cancer cells, glioblastoma cells, glioma cells, cervical cancer cells, promyelocytic leukemia cells, lung cancer cells, pituitary tumor cells, and T cell leukemia cells;
   wherein, previous to said modification, the cell did not express a magnetosome-like structure, and after said modification, the cell expresses a magnetosome-like structure comprising a lipid bilayer, an internal, iron containing region, and at least one of said magnetosome transmembrane protein within its lipid bilayer, wherein the at least one magnetosome transmembrane protein is an iron transport protein, and wherein said one or more magnetosome genes is MagA, wherein the isolated cell excludes a human embryonic stem cell.

2. The method of claim 1, wherein the magnetosome-like structure is further isolated from the cell.

3. An isolated cell made by the method of claim 1.

4. The cell of claim 3, wherein said magnetosome transmembrane protein is comprised within a fusion protein.

5. The cell of claim 4, wherein said fusion protein comprises MagA or a variant thereof and a polypeptide selected from the group consisting of a therapeutic polypeptide, a carrier polypeptide, and a targeting polypeptide.

6. The cell of claim 3, wherein said cell is a mammalian cell.

7. The cell of claim 3, wherein said cell is a mammalian cell selected from the group consisting of human, rat, mouse, dog, pig, and horse.

8. The cell of claim 6, wherein said one or more nucleic acid sequences is codon optimized for expression in mammalian cells.

9. The cell of claim 3, wherein said one or more nucleic acid sequences is codon optimized for expression in mammalian cells.

10. The method of claim 1, wherein said cell is an embryonic stem cell.

11. The method of claim 1, wherein said cell is an islet cell.

12. The method of claim 1, wherein said cell is a neuroblastoma cell.

13. The method of claim 1, wherein said cell is a breast cancer cell.

14. The method of claim 1 wherein the one or more magnetosome genes comprises two or more magnetosome genes.

15. The method of claim 14 wherein the two or more magnetosome genes are MamK and MagA.

16. A method of imaging a collection of cells or a tissue, said collection of cells or tissue comprising cells of claim 3, and further comprising detecting the presence of iron particles within the cells.

17. A method of claim 16 wherein the detecting of the presence of iron particles comprises magnetic resonance imaging.

18. A method of claim 16 wherein the detecting of the presence of iron particles comprises X-ray CT.

19. A contrast agent comprising the cell of claim 3.

20. A method of detecting the contrast agent of claim 19 comprising applying a magnetic or electromagnetic field to said contrast agent.

* * * * *